(12) United States Patent
Stevenson

(10) Patent No.: US 10,500,237 B2
(45) Date of Patent: Dec. 10, 2019

(54) COMPOSITIONS COMPRISING BACTERIAL STRAINS

(71) Applicant: 4D Pharma Research Limited, Aberdeen (GB)

(72) Inventor: Alex Stevenson, Leeds (GB)

(73) Assignee: 4D PHARMA RESEARCH LIMITED, Aberdeen (GB)

(*) Notice: Subject to any disclaimer, the term of this patent is extended or adjusted under 35 U.S.C. 154(b) by 0 days.

(21) Appl. No.: 15/842,635

(22) Filed: Dec. 14, 2017

(65) Prior Publication Data

US 2018/0133265 A1    May 17, 2018

Related U.S. Application Data

(63) Continuation of application No. PCT/GB2016/051774, filed on Jun. 15, 2016.

(30) Foreign Application Priority Data

Jun. 15, 2015 (GB) .................................. 1510468.0
Apr. 19, 2016 (GB) .................................. 1606807.4

(51) Int. Cl.
| | |
|---|---|
| A61K 39/02 | (2006.01) |
| A61K 35/74 | (2015.01) |
| A61P 37/00 | (2006.01) |
| A61P 11/06 | (2006.01) |
| A61P 19/02 | (2006.01) |
| A61K 9/19 | (2006.01) |

(52) U.S. Cl.
CPC .............. *A61K 35/74* (2013.01); *A61K 9/19* (2013.01); *A61P 11/06* (2018.01); *A61P 19/02* (2018.01); *A61P 37/00* (2018.01)

(58) Field of Classification Search
None
See application file for complete search history.

(56) References Cited

U.S. PATENT DOCUMENTS

| | | | |
|---|---|---|---|
| 3,817,837 A | 6/1974 | Rubenstein et al. | |
| 3,850,752 A | 11/1974 | Schuurs et al. | |
| 3,939,350 A | 2/1976 | Kronick et al. | |
| 3,996,345 A | 12/1976 | Ullman et al. | |
| 4,275,149 A | 6/1981 | Litman et al. | |
| 4,277,437 A | 7/1981 | Maggio | |
| 4,366,241 A | 12/1982 | Tom et al. | |
| 4,683,202 A | 7/1987 | Mullis et al. | |
| 4,816,567 A | 3/1989 | Cabilly et al. | |
| 5,589,168 A | 12/1996 | Allen et al. | |
| 5,599,795 A | 2/1997 | McCann et al. | |
| 5,674,707 A | 10/1997 | Hintz et al. | |
| 5,741,665 A | 4/1998 | Kato et al. | |
| 5,925,657 A | 7/1999 | Seed et al. | |
| 5,951,977 A | 9/1999 | Nisbet et al. | |
| 6,348,452 B1 | 2/2002 | Brown et al. | |
| 6,468,964 B1 | 10/2002 | Rowe et al. | |
| 6,645,530 B1 | 11/2003 | Borody | |
| 7,101,565 B2 | 9/2006 | Monte | |
| 7,485,325 B2 | 2/2009 | Swain | |
| 7,625,704 B2 | 12/2009 | Fredricks et al. | |
| 7,749,494 B2 | 7/2010 | Renaud et al. | |
| 7,998,474 B2 | 8/2011 | Kelly | |
| 8,197,805 B2 | 6/2012 | Lin et al. | |
| 8,287,932 B2 | 10/2012 | Rosales et al. | |
| 8,460,648 B2 | 6/2013 | Borody | |
| 8,557,233 B2 | 10/2013 | MacSharry et al. | |
| 9,011,834 B1 | 4/2015 | McKenzie et al. | |
| 9,314,489 B2 | 4/2016 | Kelly et al. | |
| 9,371,510 B2 | 6/2016 | Moore | |
| 9,376,473 B2 | 6/2016 | Gleiberman et al. | |
| 9,539,293 B2 | 1/2017 | Kelly et al. | |
| 9,610,307 B2 | 4/2017 | Berry et al. | |
| 9,662,381 B2 | 5/2017 | Honda et al. | |
| 9,796,762 B2 | 10/2017 | Kelly et al. | |
| 9,808,519 B2 | 11/2017 | Honda et al. | |
| 9,839,655 B2 | 12/2017 | Mulder et al. | |
| 9,855,302 B2 | 1/2018 | Gajewski et al. | |
| 9,974,815 B2 | 5/2018 | Mulder et al. | |
| 9,987,311 B2 | 6/2018 | Mulder et al. | |
| 10,046,015 B2 | 8/2018 | Mulder et al. | |
| 10,058,574 B2 | 8/2018 | Grant et al. | |
| 10,080,772 B2 | 9/2018 | Crouzet et al. | |
| 10,086,020 B2 | 10/2018 | Bernalier-Donadille et al. | |

(Continued)

FOREIGN PATENT DOCUMENTS

| | | |
|---|---|---|
| CA | 2768301 A | 1/2011 |
| CA | 2768301 A1 | 1/2011 |

(Continued)

OTHER PUBLICATIONS

Schiek et al (J.Allergy Clin Immunol. Mar. 2014 pp. 888-891).*
Christmann et al (J. Allergy Clin Immunol 136(5): 1378-1386; available online May 23, 2015).*
Sun et al (Genes & Disease. 1(2): 132-139, Dec. 2014).*
4d Pharma Plc: "Clinical Update—RNS—London Stock Exchange", Jul. 19, 2016.
Anonymous: "4D pharma's Blautix for Irritable Bowel Syndrome shows positive impact—pharmaceutical daily news", Dec. 13, 2016.
ATCC Catalog, https://www.atcc.org/search_results.aspx?dsNav=Ntk:primarysearch%7cbacteroides+thetaiotaomicron%7c3%7c,Ny:true,ro:0,N:1000552&searchterms=bacteroides+thetaiotaomicron&redir=1, Accessed on May 2, 2018.

(Continued)

*Primary Examiner* — Jennifer E Graser

(74) *Attorney, Agent, or Firm* — Wilson Sonsini Goodrich & Rosati

(57) ABSTRACT

Provided are pharmaceutical compositions that comprise bacteria strains of the genus *Roseburia* for treating inflammatory and autoimmune diseases. Also provided are methods of treating inflammatory and autoimmune diseases using pharmaceutical compositions that comprise bacteria strains of the genus *Roseburia*. Inflammatory and autoimmune diseases for treatment with the disclosed pharmaceutical compositions can include asthma.

20 Claims, 69 Drawing Sheets

Specification includes a Sequence Listing.

(56) References Cited

U.S. PATENT DOCUMENTS

| | | |
|---|---|---|
| 10,086,021 B2 | 10/2018 | Jeffery et al. |
| 10,086,022 B2 | 10/2018 | Bernalier-Donadille et al. |
| 10,086,023 B2 | 10/2018 | Bernalier-Donadille et al. |
| 2003/0147858 A1 | 8/2003 | Renaud et al. |
| 2004/0005304 A1 | 1/2004 | Brudnak |
| 2004/0106564 A1 | 6/2004 | Nilius et al. |
| 2006/0062774 A1 | 3/2006 | Davis et al. |
| 2006/0073161 A1 | 4/2006 | Breton |
| 2006/0115465 A1 | 6/2006 | MacFarlane et al. |
| 2007/0167423 A1 | 7/2007 | Bergauer et al. |
| 2007/0258953 A1 | 11/2007 | Duncan et al. |
| 2007/0286913 A1 | 12/2007 | Swain et al. |
| 2008/0069861 A1 | 3/2008 | Brown et al. |
| 2008/0206212 A1 | 8/2008 | McMahon et al. |
| 2008/0260906 A1 | 10/2008 | Stojanovic |
| 2008/0299098 A1 | 12/2008 | Se et al. |
| 2009/0217401 A1 | 8/2009 | Korman et al. |
| 2010/0028449 A1 | 2/2010 | Prakash et al. |
| 2010/0047209 A1 | 2/2010 | Stanton et al. |
| 2010/0247489 A1 | 9/2010 | Saur-Brosch |
| 2010/0284973 A1 | 11/2010 | Schiffer-Mannioui et al. |
| 2010/0303782 A1 | 12/2010 | Cobb et al. |
| 2010/0311686 A1 | 12/2010 | Kasper et al. |
| 2010/0316617 A1 | 12/2010 | Renaud et al. |
| 2011/0053829 A1 | 3/2011 | Baumhof et al. |
| 2011/0086011 A1 | 4/2011 | Kasper et al. |
| 2011/0280840 A1 | 11/2011 | Blaser et al. |
| 2012/0020943 A1 | 1/2012 | Lin |
| 2012/0107279 A1 | 5/2012 | Arigoni et al. |
| 2013/0022575 A1 | 1/2013 | Cassity |
| 2013/0130988 A1 | 5/2013 | Blareau et al. |
| 2013/0195802 A1 | 8/2013 | Moore |
| 2013/0280724 A1 | 10/2013 | Ramadan et al. |
| 2013/0316032 A1 | 11/2013 | Itoh et al. |
| 2013/0336931 A1 | 12/2013 | Wadstroem et al. |
| 2014/0037716 A1 | 2/2014 | Nowill et al. |
| 2014/0056852 A1 | 2/2014 | Guglielmetti et al. |
| 2014/0112897 A1 | 4/2014 | Pyne et al. |
| 2014/0147425 A1 | 5/2014 | Henn et al. |
| 2014/0154218 A1 | 6/2014 | Kohno et al. |
| 2014/0179770 A1 | 6/2014 | Zhang et al. |
| 2014/0193464 A1 | 7/2014 | Lin et al. |
| 2014/0199281 A1 | 7/2014 | Henn et al. |
| 2014/0227227 A1 | 8/2014 | Qin et al. |
| 2014/0328803 A1 | 11/2014 | McKenzie et al. |
| 2014/0335131 A1 | 11/2014 | Mazmanian et al. |
| 2014/0341921 A1 | 11/2014 | Honda et al. |
| 2014/0363397 A1 | 12/2014 | Allen-Vercoe et al. |
| 2015/0044173 A1 | 2/2015 | Jones et al. |
| 2015/0071957 A1 | 3/2015 | Kelly et al. |
| 2015/0104418 A1 | 4/2015 | Flint et al. |
| 2015/0132264 A1 | 5/2015 | Kelly et al. |
| 2015/0284781 A1 | 10/2015 | Klumpp et al. |
| 2016/0058804 A1 | 3/2016 | Jones et al. |
| 2016/0067188 A1 | 3/2016 | Cade et al. |
| 2016/0184370 A1 | 6/2016 | McKenzie et al. |
| 2016/0199424 A1 | 7/2016 | Berry et al. |
| 2016/0223553 A1 | 8/2016 | Sears et al. |
| 2016/0279177 A1 | 9/2016 | Kelly et al. |
| 2017/0143772 A1 | 5/2017 | Mulder et al. |
| 2017/0143773 A1 | 5/2017 | Mulder et al. |
| 2017/0143774 A1 | 5/2017 | Mulder et al. |
| 2017/0143775 A1 | 5/2017 | Mulder et al. |
| 2017/0173089 A1 | 6/2017 | Kelly |
| 2017/0319634 A1 | 11/2017 | Grant et al. |
| 2017/0326184 A1 | 11/2017 | Patterson et al. |
| 2017/0326202 A1 | 11/2017 | Kelly |
| 2017/0354695 A1 | 12/2017 | Grant et al. |
| 2017/0360856 A1 | 12/2017 | Grant et al. |
| 2017/0368110 A1 | 12/2017 | Grant et al. |
| 2018/0055892 A1 | 3/2018 | Mulder et al. |
| 2018/0072778 A1 | 3/2018 | Kelly et al. |
| 2018/0078585 A1 | 3/2018 | Mulder et al. |
| 2018/0078587 A1 | 3/2018 | Crott et al. |

FOREIGN PATENT DOCUMENTS

| | | |
|---|---|---|
| CN | 1863540 A | 11/2006 |
| CN | 1917946 A | 2/2007 |
| CN | 1954066 A | 4/2007 |
| CN | 101590081 A | 12/2009 |
| CN | 102304483 A | 1/2012 |
| CN | 102031235 B | 7/2012 |
| CN | 102093967 B | 1/2013 |
| CN | 102905558 A | 1/2013 |
| CN | 102940652 A | 2/2013 |
| CN | 102373172 B | 3/2013 |
| CN | 103037876 A | 4/2013 |
| CN | 103142656 A | 6/2013 |
| CN | 103146620 A | 6/2013 |
| CN | 103156888 A | 6/2013 |
| CN | 103652322 A | 3/2014 |
| CN | 103781487 A | 5/2014 |
| CN | 103820363 A | 5/2014 |
| CN | 103849590 A | 6/2014 |
| CN | 103865846 A | 6/2014 |
| CN | 103930117 A | 7/2014 |
| CN | 103981115 A | 8/2014 |
| CN | 103981117 A | 8/2014 |
| CN | 104160014 A | 11/2014 |
| CN | 104195075 A | 12/2014 |
| CN | 103509741 B | 2/2015 |
| CN | 102940652 B | 3/2015 |
| CN | 104435000 A | 3/2015 |
| CN | 103037876 B | 4/2015 |
| CN | 104546932 A | 4/2015 |
| CN | 104546933 A | 4/2015 |
| CN | 104546934 A | 4/2015 |
| CN | 104546935 A | 4/2015 |
| CN | 104546940 A | 4/2015 |
| CN | 104546942 A | 4/2015 |
| CN | 104560820 A | 4/2015 |
| CN | 105112333 A | 12/2015 |
| CN | 103820363 B | 2/2016 |
| CN | 103865846 B | 3/2016 |
| CN | 105982919 A | 10/2016 |
| DE | 19826928 A1 | 12/1999 |
| DE | 10206995 A1 | 9/2003 |
| EP | 0120516 A2 | 10/1984 |
| EP | 0238023 A2 | 9/1987 |
| EP | 0433299 A1 | 6/1991 |
| EP | 0449375 A2 | 10/1991 |
| EP | 0581171 A1 | 2/1994 |
| EP | 0778778 A1 | 6/1997 |
| EP | 0888118 A1 | 1/1999 |
| EP | 1141235 A2 | 10/2001 |
| EP | 1227152 A1 | 7/2002 |
| EP | 1383514 A1 | 1/2004 |
| EP | 1448995 A1 | 8/2004 |
| EP | 1481681 A1 | 12/2004 |
| EP | 1765391 A1 | 3/2007 |
| EP | 1675481 B1 | 11/2008 |
| EP | 1997499 A1 | 12/2008 |
| EP | 1997905 A1 | 12/2008 |
| EP | 1997906 A1 | 12/2008 |
| EP | 1997907 A1 | 12/2008 |
| EP | 2044436 A2 | 4/2009 |
| EP | 2103226 A1 | 9/2009 |
| EP | 2133088 A3 | 1/2010 |
| EP | 1280541 B2 | 3/2010 |
| EP | 2236598 A1 | 10/2010 |
| EP | 2286832 A1 | 2/2011 |
| EP | 2308498 A1 | 4/2011 |
| EP | 2217253 B1 | 6/2011 |
| EP | 1940243 B1 | 8/2011 |
| EP | 2359838 A1 | 8/2011 |
| EP | 1855550 B1 | 10/2011 |
| EP | 1871400 B1 | 10/2011 |
| EP | 2124972 B1 | 6/2012 |
| EP | 1773361 B2 | 9/2012 |
| EP | 1945234 B1 | 12/2012 |
| EP | 2323493 B8 | 12/2012 |
| EP | 2323494 B8 | 12/2012 |
| EP | 1629850 B2 | 5/2013 |

(56) References Cited

FOREIGN PATENT DOCUMENTS

| | | |
|---|---|---|
| EP | 2203551 B1 | 8/2013 |
| EP | 2140771 B1 | 12/2013 |
| EP | 2687227 A1 | 1/2014 |
| EP | 2179028 B1 | 8/2014 |
| EP | 2650002 A4 | 8/2014 |
| EP | 2164349 B1 | 9/2014 |
| EP | 2134835 B1 | 10/2014 |
| EP | 2810652 A2 | 12/2014 |
| EP | 2305838 B1 | 1/2015 |
| EP | 2832859 A1 | 2/2015 |
| ES | 2408279 A2 | 6/2013 |
| JP | H08259450 A | 10/1996 |
| JP | 2003261453 A | 9/2003 |
| JP | 2005097280 A | 4/2005 |
| JP | 2006265212 A | 10/2006 |
| JP | 2007084533 A | 4/2007 |
| JP | 2007116991 A | 5/2007 |
| JP | 2008195635 A | 8/2008 |
| JP | 2009507023 A | 2/2009 |
| JP | 2010246523 A | 11/2010 |
| JP | 5031249 B2 | 9/2012 |
| JP | 2013005759 A | 1/2013 |
| JP | 5183848 B2 | 4/2013 |
| JP | 2013527240 A | 6/2013 |
| JP | 2013201912 A | 10/2013 |
| JP | 2014196260 A | 10/2014 |
| JP | 2014534957 A | 12/2014 |
| JP | 2015500792 A | 1/2015 |
| JP | 5710876 B2 | 4/2015 |
| JP | 5792105 B2 | 10/2015 |
| KR | 100468522 B1 | 1/2005 |
| KR | 20100128168 A | 12/2010 |
| KR | 1020100128168 | 12/2010 |
| KR | 101017448 B1 | 2/2011 |
| KR | 101057357 B1 | 8/2011 |
| KR | 20130021764 A | 3/2013 |
| KR | 101250463 B1 | 4/2013 |
| KR | 20140037544 A | 3/2014 |
| KR | 20140061328 A | 5/2014 |
| PL | 229020 B1 | 5/2018 |
| RU | 2078815 C1 | 5/1997 |
| TW | I417054 B | 12/2013 |
| WO | WO-8807865 A1 | 10/1988 |
| WO | WO-9117243 A1 | 11/1991 |
| WO | WO-9611014 A1 | 4/1996 |
| WO | WO-9720577 A1 | 6/1997 |
| WO | WO-9730717 A1 | 8/1997 |
| WO | WO-9735956 A1 | 10/1997 |
| WO | WO-9843081 A1 | 10/1998 |
| WO | WO-9855131 A1 | 12/1998 |
| WO | WO-9857631 A1 | 12/1998 |
| WO | WO-9919459 A1 | 4/1999 |
| WO | WO-9942568 A1 | 8/1999 |
| WO | WO-9945955 A1 | 9/1999 |
| WO | WO-0116120 A1 | 3/2001 |
| WO | WO-0158275 A2 | 8/2001 |
| WO | WO-0185187 A1 | 11/2001 |
| WO | WO-0193904 A1 | 12/2001 |
| WO | WO-0207741 A1 | 1/2002 |
| WO | WO-0242328 A2 | 5/2002 |
| WO | WO-02070670 A1 | 9/2002 |
| WO | WO-02085933 A1 | 10/2002 |
| WO | WO-02094296 A1 | 11/2002 |
| WO | WO-03010297 A1 | 2/2003 |
| WO | WO-03022255 A2 | 3/2003 |
| WO | WO-03045317 A2 | 6/2003 |
| WO | WO-03046580 A1 | 6/2003 |
| WO | WO-03053220 A2 | 7/2003 |
| WO | WO-2004003235 A3 | 6/2004 |
| WO | WO-2004085628 A1 | 10/2004 |
| WO | WO-2005007834 A1 | 1/2005 |
| WO | WO-2005030133 A2 | 4/2005 |
| WO | WO-2005032567 A2 | 4/2005 |
| WO | WO-2005058335 A1 | 6/2005 |
| WO | WO-2005032567 A3 | 7/2005 |
| WO | WO-2005093049 A1 | 10/2005 |
| WO | WO-2005107381 A2 | 11/2005 |
| WO | WO-2005121130 A2 | 12/2005 |
| WO | WO-2006012586 A2 | 2/2006 |
| WO | WO-2006033949 A1 | 3/2006 |
| WO | WO-2006033950 A1 | 3/2006 |
| WO | WO-2006033951 A1 | 3/2006 |
| WO | WO-2006102350 A1 | 9/2006 |
| WO | WO-2006102536 A2 | 9/2006 |
| WO | WO-2006091103 A3 | 10/2006 |
| WO | WO-2006110406 A2 | 10/2006 |
| WO | WO-2006130205 A1 | 12/2006 |
| WO | WO-2007027761 A2 | 3/2007 |
| WO | WO-2007056218 A2 | 5/2007 |
| WO | WO-2007064732 A1 | 6/2007 |
| WO | WO-2007064749 A1 | 6/2007 |
| WO | WO-2007098371 A2 | 8/2007 |
| WO | WO-2007136719 A2 | 11/2007 |
| WO | WO-2007140230 A3 | 2/2008 |
| WO | WO-2008031438 A3 | 5/2008 |
| WO | WO-2008055702 A1 | 5/2008 |
| WO | WO-2008055703 A2 | 5/2008 |
| WO | WO-2008064489 A1 | 6/2008 |
| WO | WO-2008073148 A2 | 6/2008 |
| WO | WO-2008076696 A2 | 6/2008 |
| WO | WO-2008053444 A3 | 7/2008 |
| WO | WO-2008083157 A2 | 7/2008 |
| WO | WO-2008134450 A2 | 11/2008 |
| WO | WO-2008153377 A1 | 12/2008 |
| WO | WO-2009027753 A1 | 3/2009 |
| WO | WO-2009030481 A1 | 3/2009 |
| WO | WO-2009055362 A1 | 4/2009 |
| WO | WO-2009059284 A2 | 5/2009 |
| WO | WO-2009072889 A1 | 6/2009 |
| WO | WO-2009079564 A2 | 6/2009 |
| WO | WO-2009043856 A3 | 7/2009 |
| WO | WO-2009080862 A1 | 7/2009 |
| WO | WO-2009100331 A2 | 8/2009 |
| WO | WO-2009116864 A1 | 9/2009 |
| WO | WO-2009128949 A2 | 10/2009 |
| WO | WO-2009138220 A1 | 11/2009 |
| WO | WO-2009149149 A1 | 12/2009 |
| WO | WO-2009151315 A1 | 12/2009 |
| WO | WO-2009154463 A2 | 12/2009 |
| WO | WO-2009156301 A1 | 12/2009 |
| WO | WO-2010002241 A1 | 1/2010 |
| WO | WO-2010036876 A2 | 4/2010 |
| WO | WO-2010037402 A1 | 4/2010 |
| WO | WO-2010037408 A1 | 4/2010 |
| WO | WO-2010037539 A1 | 4/2010 |
| WO | WO-2010048481 A1 | 4/2010 |
| WO | WO-2010063601 A1 | 6/2010 |
| WO | WO-2010081126 A3 | 9/2010 |
| WO | WO-2010129839 A1 | 11/2010 |
| WO | WO-2010130659 A1 | 11/2010 |
| WO | WO-2010130660 A1 | 11/2010 |
| WO | WO-2010130662 A1 | 11/2010 |
| WO | WO-2010130663 A1 | 11/2010 |
| WO | WO-2010130697 A1 | 11/2010 |
| WO | WO-2010130699 A1 | 11/2010 |
| WO | WO-2010130700 A1 | 11/2010 |
| WO | WO-2010130701 A1 | 11/2010 |
| WO | WO-2010130702 A1 | 11/2010 |
| WO | WO-2010130704 A1 | 11/2010 |
| WO | WO-2010130710 A1 | 11/2010 |
| WO | WO-2010130713 A1 | 11/2010 |
| WO | WO-2010/143940 A1 | 12/2010 |
| WO | WO-2010139531 A1 | 12/2010 |
| WO | WO-2010142504 A1 | 12/2010 |
| WO | WO-2010143961 A1 | 12/2010 |
| WO | WO-2010147714 A3 | 12/2010 |
| WO | WO-2010133475 A3 | 1/2011 |
| WO | WO-2011000620 A1 | 1/2011 |
| WO | WO-2011000621 A1 | 1/2011 |
| WO | WO-2011005756 A1 | 1/2011 |
| WO | WO-2010133472 A3 | 2/2011 |
| WO | WO-2011020748 A1 | 2/2011 |
| WO | WO-2011036539 A1 | 3/2011 |
| WO | WO-2011043654 A1 | 4/2011 |

(56) References Cited

FOREIGN PATENT DOCUMENTS

| | | |
|---|---|---|
| WO | WO-2011044208 A1 | 4/2011 |
| WO | WO-2011058535 A1 | 5/2011 |
| WO | WO-2011075138 A1 | 6/2011 |
| WO | WO-2011096808 A1 | 8/2011 |
| WO | WO-2011096809 A1 | 8/2011 |
| WO | WO-2011110918 A1 | 9/2011 |
| WO | WO-2011121379 A1 | 10/2011 |
| WO | WO-2011149335 A1 | 12/2011 |
| WO | WO-2011152566 A2 | 12/2011 |
| WO | WO-2011153226 A2 | 12/2011 |
| WO | WO-2011157816 A1 | 12/2011 |
| WO | WO-2012012874 A1 | 2/2012 |
| WO | WO-2012016287 A2 | 2/2012 |
| WO | WO-2012024638 A2 | 2/2012 |
| WO | WO-2011153226 A3 | 3/2012 |
| WO | WO-2012055408 A1 | 5/2012 |
| WO | WO-2012062780 A1 | 5/2012 |
| WO | WO-2012071380 A1 | 5/2012 |
| WO | WO-2012076739 A1 | 6/2012 |
| WO | WO-2012105312 A1 | 8/2012 |
| WO | WO-2012122478 A1 | 9/2012 |
| WO | WO-2012140636 A1 | 10/2012 |
| WO | WO-2012142605 A1 | 10/2012 |
| WO | WO-2012145491 A2 | 10/2012 |
| WO | WO-2012158517 A1 | 11/2012 |
| WO | WO-2012165843 A2 | 12/2012 |
| WO | WO-2012170478 A2 | 12/2012 |
| WO | WO-2013005836 A1 | 1/2013 |
| WO | WO-2013008039 A2 | 1/2013 |
| WO | WO-2013008102 A2 | 1/2013 |
| WO | WO-2013037068 A1 | 3/2013 |
| WO | WO-2013050792 A1 | 4/2013 |
| WO | WO-2013053836 A1 | 4/2013 |
| WO | WO-2013063849 A1 | 5/2013 |
| WO | WO-2013080561 A1 | 6/2013 |
| WO | WO-2013124725 A1 | 8/2013 |
| WO | WO-2013144701 A1 | 10/2013 |
| WO | WO-2013153358 A1 | 10/2013 |
| WO | WO-2013154725 A1 | 10/2013 |
| WO | WO-2013171515 A1 | 11/2013 |
| WO | WO-2013175038 A1 | 11/2013 |
| WO | WO-2013181694 A1 | 12/2013 |
| WO | WO-2013182038 A1 | 12/2013 |
| WO | WO-2014001368 A1 | 1/2014 |
| WO | WO-2014019271 A1 | 2/2014 |
| WO | WO-2014020004 A1 | 2/2014 |
| WO | WO-2014032108 A1 | 3/2014 |
| WO | WO-2014036182 A2 | 3/2014 |
| WO | WO-2014043593 A2 | 3/2014 |
| WO | WO-2014053608 A1 | 4/2014 |
| WO | WO-2014064359 A1 | 5/2014 |
| WO | WO-2014067976 A1 | 5/2014 |
| WO | WO-2014070014 A1 | 5/2014 |
| WO | WO-2014070225 A1 | 5/2014 |
| WO | WO-2014075745 A1 | 5/2014 |
| WO | WO-2014078911 A1 | 5/2014 |
| WO | WO-2014082050 A1 | 5/2014 |
| WO | WO-2014093622 A2 | 6/2014 |
| WO | WO-2014093635 A1 | 6/2014 |
| WO | WO-2014093655 A2 | 6/2014 |
| WO | WO-2014121298 A2 | 8/2014 |
| WO | WO-2014121301 A1 | 8/2014 |
| WO | WO-2014121302 A2 | 8/2014 |
| WO | WO-2014121304 A1 | 8/2014 |
| WO | WO-2014130540 A1 | 8/2014 |
| WO | WO-2014137211 A1 | 9/2014 |
| WO | WO-2014145958 A2 | 9/2014 |
| WO | WO-2014150094 A1 | 9/2014 |
| WO | WO-2014152338 A1 | 9/2014 |
| WO | WO-2014153194 A2 | 9/2014 |
| WO | WO-2014121302 A3 | 10/2014 |
| WO | WO-2014167338 A1 | 10/2014 |
| WO | WO-2014182966 A1 | 11/2014 |
| WO | WO-2014200334 A1 | 12/2014 |
| WO | WO-2014201037 A2 | 12/2014 |
| WO | WO-2015003001 A1 | 1/2015 |
| WO | WO-2015006355 A2 | 1/2015 |
| WO | WO-2015013214 A2 | 1/2015 |
| WO | WO-2015017625 A1 | 2/2015 |
| WO | WO-2015021936 A1 | 2/2015 |
| WO | WO-201503305 A1 | 3/2015 |
| WO | WO-2015038731 A1 | 3/2015 |
| WO | WO-2015057151 A1 | 4/2015 |
| WO | WO-2015077794 A1 | 5/2015 |
| WO | WO-2015095241 A2 | 6/2015 |
| WO | WO-2015077794 A4 | 7/2015 |
| WO | WO-2015156419 A1 | 10/2015 |
| WO | WO-2015156519 A1 | 10/2015 |
| WO | WO-2015168534 A1 | 11/2015 |
| WO | WO-2015169944 A1 | 11/2015 |
| WO | WO-2015095241 A4 | 12/2015 |
| WO | WO-2016019506 A1 | 2/2016 |
| WO | WO-2016033439 A2 | 3/2016 |
| WO | WO-2016036615 A1 | 3/2016 |
| WO | WO-2016057671 A1 | 4/2016 |
| WO | WO-2016065324 A1 | 4/2016 |
| WO | WO-2016069795 A2 | 5/2016 |
| WO | WO-2016069801 A1 | 5/2016 |
| WO | WO-2016070151 A1 | 5/2016 |
| WO | WO-2016086161 A1 | 6/2016 |
| WO | WO-2016086205 A2 | 6/2016 |
| WO | WO-2016086206 A1 | 6/2016 |
| WO | WO-2016086208 A1 | 6/2016 |
| WO | WO-2016086209 A1 | 6/2016 |
| WO | WO-2016086210 A1 | 6/2016 |
| WO | WO-2016102950 A1 | 6/2016 |
| WO | WO-2016102951 A1 | 6/2016 |
| WO | WO-2016118730 A1 | 7/2016 |
| WO | WO-2016139217 A1 | 9/2016 |
| WO | WO-2016149449 A1 | 9/2016 |
| WO | WO-2016149687 A1 | 9/2016 |
| WO | WO-2016203218 A1 | 12/2016 |
| WO | WO-2016203220 A1 | 12/2016 |
| WO | WO-2017085520 A1 | 5/2017 |
| WO | WO-2017091753 A1 | 6/2017 |
| WO | WO-2017148596 A1 | 9/2017 |
| WO | WO-2018011594 A1 | 1/2018 |
| WO | WO-2018/112365 A2 | 6/2018 |
| WO | WO-2018112363 | 6/2018 |
| WO | WO-2018112363 A1 | 6/2018 |
| WO | WO-2018112365 A2 | 6/2018 |
| WO | WO-2018215782 A1 | 11/2018 |

OTHER PUBLICATIONS

Barry, et al., Criteria for Disksusceptibility tests and quality control guidelines for the cefoperazone-sulbactam combination, Journal of clinical microbiology, Jan. 1988;26(1):13-17.

Bernalier et al. *Ruminococcus hydrogenotrophicus* sp. nov., a new H2/CO2-utilizing acetogenic bacterium isolated from human feces. 1996 Arch. Microbiol. 166 (3), 176-183.

Bressa, et al., Differences in gut microbiota profile between women with active lifestyle and sedentary women. Plos One, 2017; 12(2): 1-20.

Brook, I., Clinical Review: Bacteremia caused by anaerobic bacteria in children. Critical Care 6(3): 7 pages (2002).

Co-pending U.S. Appl. No. 15/969,543, filed May 2, 2018.

Distrutti, et al., Gut Microbiota role in irritable bowel syndrome: New therapeutic strategies. World Journal of Gastroenterology. Feb. 21, 2016; 22(7): p. 2219-2241, XP002769875.

Falony, et al., Coculture Fermentations of Bifidobacterium species and bacteroides thetaiotaomicron Reveal a mechanistic insight into the prebiotic effect of inulin-type Fructans. Applied and environmental microbiology, Apr. 2009;75(8):2312-2319.

International search report with written opinion dated Feb. 26, 2018 for PCT/GB2017/053722.

Ishikawa, et al., Effect of bifidobacteria to suppress Th17, Food Science and technology institute, 2008, 5 Pages.

Kelly, et al., Commensal gut bacteria: mechanisms of immune modulation. Trends in immunology, 2005;26(6):326-333.

(56) References Cited

OTHER PUBLICATIONS

Kirsty Minton: Mucosal immunology: The ins and outs of gut inflammation, The journal of immunology, 4(2), Feb. 1, 2004: pp. 81-81, XP055252701.
Lee, et al. Intestinal microbiota in pathophysiology and management of irritable bowel syndrome . 2014. World J Gastroenterol. 20(27): 8886-8897.
Liu et al. Reclassification of Clostridium coccoides, Ruminococcus hansenii, Ruminococcus hydrogenotrophicus, Ruminococcus luti, Ruminococcus productus and Ruminococcus schinkii as *Blautia coccoides* gen. nov., comb. nov., *Blautia hansenii* comb. nov., *Blautia hydrogenotrophica* comb. nov., *Blautia luti* comb. nov., *Blautia producta* comb. nov., *Blautia schinkii* comb. nov. and description of *Blautia wexlerae* sp. nov., isolated from human faeces. 2008. Int J Syst Evol Microbiol 58,1896-1902.
Lopetuso et al. Commensal Clostridia: leading players in the maintenance of gut homeostasis. 2013. Gut Pathogens, 5: 23.
Nuala Moran: 'Microbial wealth', chemistry and industry, 78(6), Jun. 1, 2014, pp. 20-23, XP055252922.
PCT/EP2017/025038 Written Opinion of the International Preliminary Examining Authority dated Jan. 1, 2018.
Robinson, et al. Inside information—The unique features of visceral sensation. 2008. Mol Interv, 8(5): 242-253.
Salix Pharmaceuticals, Inc. FDA Highlights of Prescribing Information—Xifaxan (rifaximin tablet). Revised Nov. 2015.
U.S. Appl. No. 15/700,007 Office Action dated Jun. 1, 2018.
Stokholm, et al., Maturation of the gut microbiome and risk of asthma in childhood. Nature Communications, 2018; 9(141): 1-10.
Tap et al. Towards the human intestinal microbiota phylogenetic core. 2009. Environ Microbiol, 11(10):2574-84.
U.S. Appl. No. 15/357,936 Notice of Allowance dated Apr. 18, 2018.
U.S. Appl. No. 15/592,178 Notice of Allowance dated Apr. 12, 2018.
U.S. Appl. No. 15/916,202 Notice of Allowance dated Jun. 11, 2018.
U.S. Appl. No. 15/359,144 Office Action dated Apr. 10, 2018.
U.S. Appl. No. 15/359,972 Office Action dated Apr. 4, 2018.
U.S. Appl. No. 15/631,945 Office Action dated May 15, 2018.
U.S. Appl. No. 15/673,270 Office Action dated Apr. 10, 2018.
Van De Bogert, et al., Immunomodulatory properties of *Streptococcus* and veillonella isolates from the human small intestine microbiota, PLOS One, Dec. 2014: 1-20, DOI:10.1371/journal.pone. 0114277.
Wrzosek, et al., Bacteroides thetaiotaomicron and Faecalibacterium prausnitzii influence the production of mucus glycans and the development of goblet cells in the colonic epithelium of a gnotobiotic model rodent. BMC biology, 2013;11(61):1-13.
Xu, et al., The endogenous hydrogen sulfide producing enzyme cystathionine-i synthase contributes to visceral hypersensitivity in a rat model of irritable bowel syndrome. Molecular Pain, Biomed central, London, GB. Aug. 6, 2009; 5(1):p. 44.
Xu, J. et al., "Message from a human gut symbiont: sensitivity is a prerequisite for sharing", Trends in microbiology, 12(1), Jan. 1, 2004: pp. 21-28, XP055253932.
Yu, et al., Utilization of major fucosylated and sialylated human milk oligosaccharides by isolated human gut microbes. Glycobiology, 2013; 23(11):1281-1292.
Zhou et al. Central and peripheral hypersensitivity in the irritable bowel syndrome. 2010. Pain. 148(3): 454-461.
Roseburia. Ubiome, 2018. Accessed on Jun. 25, 2018; Available at: https://shop.ubiome.com/pages/roseburia-1.
Altschul et al. 'Basic local alignment search tool.' Journal of Molecular Biology. 1990, vol. 215, No. 3, pp. 403-410.
"Amedei, A. et al. Multiple sclerosis: the role of cytokines in pathogenesis and in therapies. Int J Mol Sci. Oct. 19, 2012;13(10):13438-60. doi: 10.3390/ijms131013438."
Aminov et al. Molecular diversity, cultivation, and improved detection by fluorescent in situ hybridization of a dominant group of human gut bacteria related to *Roseburia* spp. or Eubacterium rectale. Applied and environmental microbiology. 2006, vol. 72, No. 9, pp. 6371-6376.
An et al. (1985) "New cloning vehicles for transformation of higher plants," EMBO J. 4:277-284.
An et al. (1988) "Binary Vectors," Plant Molecular Biology Manual. A3:1-19.
An et al. Transformation of Tobacco, Tomato, Potato, and *Arabiodopsis thaliana* Using a Binary Ti Vector System,Plant Physiol. May 1986; 81:301-305.
Archer et al. (1997) "The Molecular Biology of Secreted Enzyme Production by Fungi," Critical Reviews Biotechnology. 17(4):273-306.
Arenberg, et al., Interferon-y-inducible Protein 10 (IP-10) Is an Angiostatic Factor That Inhibits Human Non-small Cell Lung Cancer (NSCLC) Tumorigenesis and Spontaneous Metastases. 1996. J. Exp.Med. 184:981-92.
Atarashi et al. Induction of colonic regulatory T cells by indigenous *Clostridium* species. Science 331(6015):337-341 (2011).
Atarashi et al., Th17 Cell Induction by Adhesion of Microbes to Intestinal Epithelial Cells. Cell, vol. 163, No. 2, Oct. 8, 2015. pp. 367-380.
Atarashi, et al., Treg induction by a rationally selected mixture of Clostridia strains from the human microbiota. Supplementary Information. Nature 500, 232-236 (Aug. 8, 2013) doi:10.1038/nature12331.
Atarashi, K. et al., Treg induction by a rationally selected mixture of Clostridia strains from the human microbiota. Nature. 2013; 500(7461):232-236.
Atlas, R. Handbook of Microbiological Media, Fourth Edition. CRC Press. 2010.
Ausubel et al. (1999) Short Protocols in Molecular Biology. 4th edition. pp. 7-58 to 7-60, and Chapter 18. pp. 18-1 to 18-23.
Ausubel, et al. Current Protocols in Molecular Biology. 1987. Supplement 30.
Ausubel et al., Short protocols in molecular biology. Fifth edition, 2002.
Azad, M.B. et al., Probiotic supplementation during pregnancy or infancy for the prevention of asthma and wheeze: systematic review and meta-analysis BMJ 2013; 347 :f6471.
Aziz et al. The RAST Server: rapid annotations using subsystems technology. BMC Genomics. 2008, vol. 9, No. 1, pp. 75.
Bagge, et al., Diversity of spore-forming bacteria in cattle manure, slaughterhouse waste and samples from biogas plants. Journal of applied microbiology. 2010;109: 1549-1565.
Balato, et al., Effects of adalimumab therapy in adult subjects with moderate-to-severe psoriasis on Th17 pathway. (2014) J Eur Acad Dermatol Venereol. 28(8):1016-24.
Banfield, J. & Murphy, K.R., Non-Th2, Late-onset, non-allergic asthma. Copd & Asthma for NPs, a peer-reviewed newsletter, Aug. 2016; 14: 8 Pages.
Barcenilla et al. "Phylogenetic relationships of butyrate-producing bacteria from the human gut" Applied and environmental microbiology. 2000, vol. 66, No. 4, pp. 1654-1661.
Beggs (1978) "Transformation of yeast by a replicating hybrid plasmid," Nature. 275:104-109.
Berg et al. (1996) "Enterocolitis and colon cancer in interleukin-10-deficient mice are associated with aberrant cytokine production and CD4(+) TH1-like responses," The Journal of Clinical Investigation. 98(4):1010-1020.
Bertram, J. et al. Establishment of a cloned line of Lewis lung carcinoma cells adapted to cell culture. (1980) Cancer let. 11:63-73.
Birdi, K.S. Handbook of Surface and Colloid Chemistry, 2nd Edition. CRC Press. 1997.
Bottacini, et al., Comparative genomics of the Bifidobacterium brevetaxon. BMC Genomics, 2014; 15:170. DOI:10.1186/1471-1-2164-15-170.
Brand et al., Collagen-induced arthritis, 2007; Protocol 2(5):1269-1275.
Brasel et al. (2000) "Generation of murine dendritic cells from flt3-ligand-supplemented bone marrow cultures," Blood. 96(9):3029-3039.

(56) References Cited

OTHER PUBLICATIONS

Busing, K. et al., Effects of oral Enterococcus faecium strain DSM 10663 NCIMB 10415 on diarrhoea patterns and performance of sucking piglets. Benef Microbes. Mar. 2015;6(1):41-4. doi: 10.3920/BM2014.0008.
Butcher et al. (1980) The role of tissue culture in the study of crown-gall tumorigenesis. Tissue Culture Methods for Plant Pathologists. Eds.: Ingrams, D. S.; Helgeson, J.P. pp. 203-208.
"Campeau, J.L. et al., Intestinal Epithelial Cells Modulate Antigen-Presenting Cell Responses to Bacterial DNA. Infectionand Immunity. Aug. 2012; 80(8): 2632-2644."
Carvalho et al. (Jan. 2011) "TLR5 activation induces secretory interleukin-1 receptor antagonist (sIl-1 Ra) and reduces inflammasome-associated tissue damage," Nature. 4(1):102-111.
Caspi, P.R. Experimental autoimmune uveoretinitis in the rat and mouse. Curr Protoc Immunol. May 2003;Chapter 15:Unit 15.6. doi: 10.1002/0471142735.im1506s53.
Cekanaviciute, et al., Gut bacteria from multiple sclerosis patients modulate human T cells and exacerbate symptoms in mouse models. PNAS. Jun. 30, 2017; 1-6.
Cereghino et al. (2000) "Heterologous protein expression in the methylotrophic yeast Pichia pastoris," FEMS Microbiol Review. 24(1):45-66.
Charriot, et al., Future treatment for ashtma, Eur Respir Rev 2016; 25: 77-92.
Cheluvappa, R. et al., T helper type 17 pathway suppression by appendicitis and appendectomy protects against colitis. Clin Exp Immunol. Feb. 2014;175(2):316-22. doi: 10.1111/cei.12237.
Chen, S. et al., Live combined bacillus subtilis and enterococcus faecium ameliorate murine experimental colitis by immunosuppression. International journal of inflammation. 2014(878054). 7 Pages.
Chevreux et al. 'Genome sequence assembly using trace signals and additional sequence information.' German Conference on Bioinformatics. 1999.
Chi, W. et al., IL-23 promotes CD4+ T cells to produce IL-17 in Vogt-Koyanagi-Harada disease. J Allergy Clin Immunol. May 2007;119(5):1218-24. Epub Mar. 1, 2007.
Chi, W. et al. Upregulated IL-23 and IL-17 in Behçet patients with active uveitis. Invest Ophthalmol Vis Sci. Jul. 2008;49(7):3058-64. doi: 10.1167/iovs.07-1390.
Chiu, et al., Monocolonization of germ-free mice with bacteroides fragilis protects against dectran sulfate sodium-induced acute colitis. Biomed Research International 2014. vol. 2014. Article ID 675786. 9 Pages.
Chothia et al. The relation between the divergence of sequence and structure in proteins. EMBO Journal. 1986, 5(4):823-826.
Christou (1994) "Genetic engineering of crop legumes and cereals: current status and recent advances," Agro-Food Industry Hi-Tech. pp. 17-27.
Chung et al. 'Microbiota-stimulated immune mechanisms to maintain gut homeostasis.' Current Opinion in Immunology. 2010, vol. 22, No. 4, pp. 455-460.
Collins, M.D., et al., *Enterococcus avium* nom. rev., comb. nov.; *E. casseliflavus* nom. rev., comb. nov.; *E. durans* nom. rev., comb. nov.; *E. gallinarum* comb. nov.; and *E. malodoratus* sp. nov. (1984) Int J Syst Evol Microbiol. 34: 220-223.
Colowick, S. and Kaplan, N., Methods of Enzymology. Academic Press, Inc.
Co-pending U.S. Appl. No. 15/906,988, filed Feb. 27, 2018.
Crellin et al. (2005) "Human CD4+ T cells express TLR5 and its ligand ftagellin enhances the suppressive capacity and expression of FOXP3 in CD4+CD25+ T regulatory cells," Journal of Immunology. 175(12):8051-8059.
Dahya V. et al., Clostridium ramosum Osteomyelitis in an immunocompetent patient after traumatic injury, Infectious Diseases in Clinical Practice Mar. 12, 2015 Lippincott Williams and Wilkins USA, vol. 23, No. 2, Mar. 12, 2015, pp. 102-104, XP009193312, ISSN: 1056-9103 the whole document.
Darlington, G.J., Liver Cell Lines. (1987) Meth Enzymol. 151:19-38.

Davis et al., Genetic and Microbiological Research Techniques, Methods Enzymol. 1970; 17A:79-143.
Day, J.G. et al., Cryopreservation and Freeze-Drying Protocols. Springer. 2007. 2nd edition.
De Paepe et al. 'Trade-off between bile resistance and nutritional competence drives *Escherichia coli* diversification in the mouse gut.' PLoS Genetics. 2011, vol. 7, No. 6, e1002107.
Demarche, et al., Detailed analysis of sputum and systemic inflammation in asthma phenotypes: are paucigranulocytic asthmatics really non-inflammatory?, BMC Pulmonary Medicine, 2016; (16)46: 1-13.
Dennis et al. 'DAVID: database for annotation, visualization, and integrated discovery.' Genome Bioi. 2003, vol. 4, No. 5, pp. 3.
Divyashri et al. Probiotic attributes, antioxidant, anti-inflammatory and neuromodulatory effects of Enterococcus faecium CFR 3003: in vitro and in vivo evidence. (2015) J Med Microbiol. doi: 10.1099/jmm.0.000184.
Duck et al. 'Isolation of flagellated bacteria implicated in Crohn's disease.' Inflammatory Bowel Diseases. 2007, vol. 13, No. 10, pp. 1191-1201.
Duncan et al. (2002) "*Roseburia intestinal* is sp. nov., a novel saccharolytic, butyrate-producing bacterium from human faeces," International Journal System Evolutionary Microbiology. 52:1615-1620.
Duncan et al. (2006) "Proposal of *Roseburia faecis* sp. nov., *Roseburia hominis* sp. nov. and *Roseburia inulinivorans* sp. nov., based on isolates from human faeces," International Journal of Systematic and Evolutionary Microbiology. vol. 56, No. Pt 10, pp. 2437-2441.
Duncan et al. "Lactate-utilizing bacteria, isolated from human feces, that produce butyrate as a major fermentation product" Applied and environmental microbiology. 2004, vol. 70, No. 10, pp. 5810-5817.
Eckburg, PB. et al., Diversity of the human intestinal microbial flora.Science. Jun. 10, 2005;308(5728):1635-8. Epub Apr. 14, 2005.
Elkins et al. 'Genes encoding bile salt hydrolases and conjugated bile salt transporters in Lactobacillus johnsonii 100-100 and other *Lactobacillus* species.' Microbiology. 2001, vol. 147, No. 12, pp. 3403-3412.
Ely et al. (2000) "A family of six flagellin genes contributes to the Caulobacter crescentus flagellar filament," Journal of Bacteriology. 182(17):5001-5004.
Extended European search report and opinion dated Aug. 23, 2016 for EP Application No. 16166001.4.
Fabro, A. et al., The Th17 pathway in the peripheral lung microenvironment interacts with expression of collagen V in the late state of experimental pulmonary fibrosis. (2015) Immunobiology. 220(1):124-35.
Faghih, Z. et a., IL-17 and IL-4 Producing CD8+ T Cells in Tumor Draining Lymph Nodes of Breast Cancer Patients: Positive Association with Tumor Progression. (2013). Iranian Journal of Immunology. 10(4):193-204.
Fahy, J.V. Eosinophilic and neutrophilic inflammation in asthma: insights from clinical studies. Proc Am Thorac Soc. May 1, 2009;6(3):256-9. doi: 10.1513/pats.200808-087RM.
Falony et al. In vitro kinetics of prebiotic inulin-type fructan fermentation by butyrate-producing colon bacteria: Implementation of online gas chromatography for quantitative analysis of carbon dioxide and hydrogen gas production. Applied and Environmental Microbiology. 2009, vol. 75, No. 18, pp. 5884-5892.
Farooq, P.D. et al., Pseudomembranous colitis, Disease-A-Month 2015 Mosby Inc. USA, vol. 61, No. 5, May 1, 2015, pp. 181-206, XP009193313, ISSN: 0011-5029 p. 195.
FDA Orphan Drug Designations. Total Orphan Drugs website. Aug. 2014. Available at http://www.orphan-drugs.org/2014/09/01/fda-orphandrug-designations-august-2014. Accessed on Apr. 13, 2016.
Fenner, et al., *Bacteroides massiliensis* sp. nov., isolated from blood culture of a newborn. International Journal of systematic and evolutionary microbiology, 2005. 55: 1335-1337.
Flores-Langarica et al. (2012) "Systemic flagellin immunization stimulates mucosal CD1 03+ dendritic cells and drives Foxp3+ regulatory T CELL and IgA responses in the mesenteric lymph node," Journal of Immunology. 189 (12):57 45-5754.

(56) References Cited

OTHER PUBLICATIONS

Fraley et al. (1986) "Genetic Transformation in Higher Plants," Critical Reviews Plant Science. 4:1-46.
Frame et al., Production of fertile transgenic maize plants by silicon carbide whisker-mediated transformation, The Plant Journal. 1994; 6:941-948.
Frank, D. et al., Molecular-phylogenetic characterization of microbial community imbalances in human inflammatory bowel diseases. 2007. PNAS. 104(34):13780-5.
Gaboriau-Routhiau et al. 'The key role of segmented filamentous bacteria in the coordinated maturation of gut helper T cell responses.' Immunity. 2009, vol. 31, No. 4, pp. 677-689.
Gait, M.J., (1984) Oligonucleotide Synthesis: A Practical Approach. Irl Press. pp. vii-xiii.
GB Exam and search report dated Aug. 30, 2016 for GB Application No. 1520638.6.
GB Search and Exam report dated Mar. 31, 2016 for GB application 1510469.8.
GB Search and Exam report dated Mar. 31, 2016 for GB application 1510470.6.
GB Search and Exam report dated Apr. 15, 2016 for GB application 1510467.2.
GB Search and Exam report dated Apr. 20, 2016 for GB application 1510466.4.
GB Search and Exam report dated Apr. 20, 2016 for GB application 1510468.0.
GB Search and Exam report dated Aug. 30, 2016 for GB application No. 1520631.1.
GB Search and Exam report dated Nov. 17, 2016 for GB application 1520502.4.
GB Search and Exam report dated Sep. 13, 2016 for GB application 1520497.7.
GenBank Accession No. ABl48297.1 (Jul. 20, 2007) "Fia1 flagellin [Roseburia hominis]".
GenBank Accession No. ABY J02000000 (Nov. 8, 2013) Version 2. "Roseburia intestinal is L 1-82, whole genome shotgun sequencing project".
GenBank Accession No.'s ABY J02000001—ABY J02000409 search results page (Last Updated Apr. 24, 2015).
GenBank accession No. AJ312385 (Oct. 9, 2002) "Roseburia intestinalis 16S rRNA gene, strain L 1-82".
GenBank Accession No. CP003040 (Aug. 5, 2011) Version 1. "Roseburia Hominis A2-183, complete genome".
GenBank Accession No. DQ789141. (Jul. 20, 2007) "Roseburia hom in is Fla2 flagellin gene".
GenBank Accession No. M20983. (Apr. 26, 1993) "R.cecicola ftagellin gene".
Gennaro, A.R. "Quality Assurance and Control," from Remington: The Science and Practice of Pharmacy, 2000, Lippincott Williams & Wilkins, 20th ed., pp. 980-983.
Gennaro, A.R., Remington's Pharmaceutical sciences, Mack publishin co. 1985.
Geraedts et al. 'Release of satiety hormones in response to specific dietary proteins is different between human and murine small intestinal mucosa.' Annals of Nutrition and Metabolism. 2010, vol. 56, No. 4, pp. 3018-3313.
Geuking et al. 'Intestinal bacterial colonization induces mutualistic regulatory T cell responses.' Immunity. 2011, vol. 34, No. 5, pp. 794-806.
Gewirtz et al. (2001) Cutting edge: bacterial flagellin activates basolaterally expressed TLR5 to induce epithelial proinflammatory gene expression. The Journal of Immunology. 167:(4)1882-1885.
Ghadimi, D. et al., Epigenetic imprinting by commensal probiotics inhibits the IL-23/IL-17 axis in an in vitro model of the intestinal mucosal immune system. JLB. 2012;92(4):895-911.
Giraud et al. 'Dissecting the genetic components of adaptation of *Escherichia coli* to the mouse gut.' PLoS Genetics.2008, vol. 4, No. 1, pp. e2.

Goldin, B.R. et al., Clinical indications for probiotics: an overview. Clin Infect Dis. Feb. 1, 2008;46 Suppl 2:S96-100; discussion S144-51. doi: 10.1086/523333.
Greenspan et al., Defining epitopes: It'not as easy as it seems. Nature Biotechnology 7: 936-937, 1999.
Guide for the care and use of laboratory animals: 8th edition. The national academic press; 2011.
Haabeth et al. A model for cancer-suppressive inflammation. (2012) OncoImmunology 1(1):1146-1152.
Hammerich, L. et al., Interleukins in chronic liver disease: lessons learned from experimental mouse models. (2014) Clin Exp Gastroenterol. 7:297-306.
Hapfelmeier et al. 'Reversible microbial colonization of germ-free mice reveals the dynamics of IgA immune responses.' Science. 2010, vol. 328, No. 5986, pp. 1705-1709.
Hayashi et al. The innate immune response to bacterial flagellin is mediated by Toll-like receptor 5. Nature. 2001, vol. 410, No. 6832, pp. 1099-1103.
Hedayat et al. (Mar. 1, 2012) "Prophylactic and therapeutic implications of toll-like receptor ligands," Medicinal Research Reviews. 32(2):294-325.
Higgins et al. (1988) "CLUSTAL: a package for performing multiple sequence alighment on a microcomputer," Gene. 73(1 ):237-244.
Hinchliffe (1993) "Yeast as a vehicle for the expression of heterologous genes," Yeasts. 2nd edition. Rose, A. R.; Harrison, J. H.: Eds. Academic Press Ltd. 5(9). pp. 325-356.
Hinnen et al., Transformation of yeast, Proc. Natl. Acad. Sci. USA. Apr. 1978; 75:1929-1933.
Hoekema (1985) The Binary Plant Vector System Offset-drukkerij Kanters BB, Alblasserdam. Chapter V. pp. 63-71.
Hold et al. 'Oligonucleotide probes that detect quantitatively significant groups of butyrate-producing bacteria in human feces.' Applied and environmental microbiology. 2003, vol. 69, No. 7, pp. 4320-4324.
Holdeman, et al., *Eubacterium contortum* (*Prevot*) comb. nov.: Emendation of description and designation of the type strain. International journal of systematic bacteriology. Oct. 1971;21(4): 304-306.
Holland et al. (1990) "Secretion of Heterologous Proteins in *Escherichia coli*," Methods Enzymology. 182:132-143.
Hollenberg et al. (1997) "Production of recombinant proteins by methulotrophic yeasts," Current Opinion Biotechnology. 8(5):554-560.
Hooper at al. 'Molecular analysis of commensal host-microbial relationships in the intestine.' Science. vol. 291, No. 5505, pp. 881-884.
Hossain et al. "Flagellin, a TLR5 agonist, reduces graft-versus-host disease in allogeneic hematopoietic stem cell transplantation recipients while enhancing antiviral immunity," Journal of Immunology. Nov. 2011; 187(10): p. 5130-5140.
Hougee, et al., Oral treatment with probiotics reduces allergic symptoms in ovalbumin-sensitized mice:a bacterial strain comparative study. Int Arch Allergy Immunol. 2010; 151:107-117.
Hoyles L. et al. Gastrointestinal Tract, Chapter 56. Handbook of Hydrocarbon and Lipid Microbiology Springer Verlag Berlin 2010, 3120-32.
Ibrahim et al., "Method for the isolation of highly purified *Salmonella flagellins*," Journal of Clinical Microbiology. Dec. 1985; 22(6):1040-1044.
Inaba et al., "Generation of large numbers of dendritic cells from mouse bone marrow cultures supplemented with granulocyte/macrophage colony-stimulating factor," J. Exp. Med. Dec. 1992; 176(6):1693-1702.
Interational Search Report for International Application No. PCT/GB2012/052495, dated Mar. 25, 2013.
International Preliminary Report on Patentability corresponding to International Patent Application No. PCT/GB2014/051123, dated Oct. 13, 2015.
International Search Report dated Jan. 27, 2017 for International Application No. PCT/GB2016/053622.
International Search Report dated Feb. 17, 2017 for International Application No. PCT/GB2016/053676.

(56) References Cited

OTHER PUBLICATIONS

International Search Report dated Aug. 21, 2014 for International Application No. PCT/GB2014/051123.
International Search Report dated Aug. 26, 2016 for International application No. PCT/GB2016/051774.
International Search Report dated Aug. 26, 2016 for International application No. PCT/GB2016/051776.
International Search Report dated Sep. 6, 2016 for International application No. PCT/GB2016/051768.
International Search Report dated Sep. 6, 2016 for International application No. PCT/GB2016/051773.
International Search Report dated Sep. 6, 2016 for International application No. PCT/GB2016/051770.
International Search Report dated Feb. 2, 2017 for International application No. PCT/GB2016/053620.
International Search Report dated Mar. 6, 2017 for International Application No. PCT/GB2016/053677.
Ispirli, H. et al., Characterization of functional properties of Enterococcus faecium strains isolated from human gut.Can. J. Microbiol. 61: 861-870 (2015) dx.doi.org/10.1139/cjm-2015-0446.
Ito et al. (1983) "Transformation of Intact Yeast Cells Treated with Alkali Cations," J. Bacteriology. 153:163-168.
Ivanov et al. 'Induction of intestinal Th17 cells by segmented filamentous bacteria.' Cell. 2009, vol. 139, No. 3, pp. 485-498.
Jarchum et al., "Toll-Like Receptor 5 Stimulation Protects Mice from Acute Clostridium difficile Colitis," Infection and Immunity. Apr. 2011; 79(4):1498-1503.
Jawad, S. et al., Elevated serum levels of interleukin-17A in uveitis patients. Ocul Immunol Inflamm. Dec. 2013;21(6):434-9. doi: 10.3109/09273948.2013.815786. Epub Aug. 19, 2013.
Jiao et al., Blockade of Notch Signaling Ameliorates Murine Collagen-Induced Arthritis via Suppressing Th1 and Th17 Cell Responses. 2014; Pathology, 184(4):1085-1093.
Kailasapathy, K. Microencapsulation of Probiotic Bacteria:Technology and Potential Applications. Curr. Issues Intest. Microbiol. (2002) 3: 39-48.
Kanauchi, et al., Eubacterium limosum ameliorates experimental colitis and metabolite of microbe attenuates colonic inflammatory action with increase of mucosal integrity introduction, China World J Gastroenterol February, Jan. 1, 2006. pp. 1071-1077.
Kanauchi, et al., Eubacterium limosum (probiotic) and its metabolites showed anti-inflammatory effects and increased mucosal barrier function in colitis. S1912.
Kang, S. et al., Dysbiosis of fecal microbiota in Crohn's disease patients as revealed by a custom phylogenetic microarray.Inflamm Bowel Dis. Dec. 2010;16(12):2034-42. doi: 10.1002/ibd.21319.
Karaffova, et al., Interaction of TGF-B4 and IL-17 with IgA secretion in the intestine of chickens fed with E. faecium AL41 and challenged with S. Enteritidis. Research in Veterinary science. 2015;75-79.
Karin, M. Nuclear factor-kappaB in cancer development and progression. Nature. May 25, 2006;441(7092):431-6.
Kelly et al. 'Commensal anaerobic gut bacteria attenuate inflammation by regulating nuclear-cytoplasmic shuttling of PPAR-y and ReiA.' Nature Immunology. 2003, vol. 5, No. 1, pp. 104-112.
Kingsley M. A Personalized Approach to Managing 18D. Gastroenterology and Hepatology 12(5)308-315, May 2016.
Kinnebrew et al., Interleukin 23 production by intestinal CD1 03(+)CD11 b(+) dendritic cells in response to Interleukin 23 production by intestinal CD1 03(+ )CD11 b(+) dendritic cells in response to bacterial flagellin enhances mucosal innate immune defense, Immunity. 2012; 36(2): 276-287.
Kitahara, M. et al., *Bacteroides plebeius* sp. nov. and *Bacteroides coprocola* sp. nov., isolated from human faeces. International journal of systematic and evolutionary microbiology. 2005; 55: 2143-2147.
Koenders, M.I. et al., Interleukin-17 Acts Independently of TNF-a under Arthritic Conditions. (2006) J. Immunol. 176:6262-6269.
Kverka, M. et al., Oral administration of Parabacteroides distasonis antigens attenuates experimental murine colitis through modulation of immunity and microbiota composition. Clinical & Experimental Immunology. 2010; 163:250-259.
Lakhdari, et al. Identification of NF-KB Modulation Capabilities within Human Intestinal Commensal Bacteria. J Biomed Biotechnol. 2011; 2011: 282356.
Laukova, A. et al. Benefits of Combinative Application of Probiotic, Enterocin M-Producing Strain Enterococcus Faecium AL41 and Eleutherococcus Senticosus in Rabbits. Folia Microbiol (Praha) 61 (2), 169-177. Sep. 9, 2015.
Lavallie et al. (1995) "Gene fusion expression systems in *Escherichia coli*," Current Opinion Biotechnology. 6 (5):501-506.
Lejeune, FJ. et al., Efficiency of Recombinant Human TNF in Human Cancer Therapy. (2006) Cancer Immun. 6:6.
Leslie, et al., Trehalose and sucrose protect both membranes and proteins in intact bacteria during drying. (1995) Appl. Environ. Microbiol. 61, 3592-3597.
Letran et al. 'TLR5-deficient mice lack basal inflammatory and metabolic defects but exhibit impaired CD4 T cell responses to a flagellated pathogen.' The Journal of Immunology. 2011, vol. 186, No. 9, pp. 5406-5412.
Lilley et al., Methods in Enzymology; DNA Structure Part A: Synthesis and Physical Analysis of DNA. 1992; vol. 2011. pp. v-vii.
Lodemann, U. et al., Effects of the Probiotic enterococcus faecium and pathogenic *Escherichia coli* strains in a pig and human epithelial intestinal cell model. Hindawi publishing corporation scientifica. 2015(235184) 10 pages.
Louis et al. 'Diversity, metabolism and microbial ecology of butyrate-producing bacteria from the human large Intestine.' FEMS Microbiology Letters. 2009, vol. 294, No. 1, pp. 1-8.
Louis et al. 'Diversity of human colonic butyrate-producing bacteria revealed by analysis of the butyryl—GoA: acetate GoA—transferase gene.' Environmental Microbiology. 2010, vol. 12, No. 2, pp. 304-314.
Louis et al. 'Organization of butyrate synthetic genes in human colonic bacteria: phylogenetic conservation and horizontal gene transfer.' FEMS Microbiology Letters. 2007, vol. 269, No. 2, pp. 240-247.
Luger, D. and Caspi, R.R., New perspectives on effector mechanisms in uveitis. (2008) Semin. Immunopathol. 30(2): 134-143.
Lyons, et al., Bacterial strain-specific induction of Foxp3 T regulatory cells is protective in murine allergy models. Clinical & Experimental Allergy. 2010; 40:811-819.
Machiels, et al., Predominant dysbiosis in patients with ulcerative colitis is different from Crohn's disease patients, Inflammatory Bowel Diseases, Microbiology 2012. 8th Congress of ECCO. (This Abstract Is in 7th Congress 2012).
Machiels, K. A decrease of the butyrate-producing species *Roseburia hominis* and *Faecalibacterium prausnitzii* defines dysbiosis in patients with ulcerative colitis.Gut. Aug. 2014;63(8):1275-83. doi: 10.1136/gutjnl-2013-304833. Epub Sep. 10, 2013.
MacPherson, AJ. et al., IgA responses in the intestinal mucosa against pathogenic and non-pathogenic microorganisms. Oct. 2001. 3(12). 1021-1035.
MacPherson, AJ., et al., The functions of mucosal T cells in containing the indigenous commensal flora of the intestine.Cell Mol Life Sci. Dec. 2002;59(12):2088-96.
MacPherson et al. 'IgA adaptation to the presence of commensal bacteria in the intestine.' Gut-Associated Lymphoid Tissues. Springer Berlin Heidelberg, 2006. 117-136.
MacSharry et al., Immunomodulatory effects of feeding with bifidobacterium longum on allergen-induced lung inflammation in the mouse. Pulmonary pharmacology & Therapeutics. 2012; 25:325-334.
Mahowald et al. 'Characterizing a model human gut microbiota composed of members of its two dominant bacterial phyla.' Proceedings of the National Academy of Sciences. 2009, vol. 106, No. 14, pp. 5859-5864.
Mallya et al. 'Characterization of the five novel Ly-6 superfamily members encoded in the MHC, and detection of cells expressing their potential ligands.' Protein Science. 2006, vol. 15, No. 10, pp. 2244-2256.

(56) References Cited

OTHER PUBLICATIONS

Manni et al., A tale of two cytokines: IL-17 and IL-22 in asthma and infection. Expert Rev Respir Med. Feb. 2014 ; 8(1): 25-42. doi:10.1586/17476348.2014.854167.
Mansour et al. Isolation of Enterococcus faecium NM113, Enterococcus faecium NM213 and Lactobacillus casei NM512 as novel probiotics with immunomodulatory properties. (2014) Microbiol Immunol. 58(10):559-69.
Martin et al., Cloning, Nucleotide Sequence, and Taxonomic Implications of the Flagellin Gene of Roseburia cecicola, Journal of Bacteriology. Jun. 1988; 170(6):2612-2617.
Masco, L., et al., Identification of *Bifidobacterium* Species Using rep-PCR Fingerprinting. Systematic and Applied Microbiology 26(4):557-63 • Dec. 2003.
Maya, J.R. et al., Emerging Therapies for Noninfectious Uveitis: What May Be Coming to the Clinics. (2014) J. Ophthalmology. 310329.
Mazmanian, SK., An immunomodulatory molecule of symbiotic bacteria directs maturation of the host immune system.Cell. Jul. 15, 2005;122(1):107-18.
McIntosh et al. 'Mechanism of conjugated linoleic acid and vaccenic acid formation in human faecal suspensions and pure cultures of intestinal bacteria.' Microbiology. 2009, vol. 155, No. 1, pp. 285-294.
McLaughlin., "McLaughlin et al. Fatty acid chain length determines cholecystokinin secretion and effect on human gastric motility. Gastroenterology. 1999, vol. 116, No. 1, pp. 46-53".
Meyer et al. (1992) "The use of cassava mosaic virus as a vector system for plants," Gene. 110:213-217.
Mikayama, et al., Molecular cloning and functional expression of a cDNA encoding glycosylation-inhibiting factor. Proc.Nati.Acad. Sci. USA, Nov. 1993; vol. 90: 10056-1 0060.
Miossec et al., Targeting IL-17 and TH17 cells in chronic inflammation, 2012; Nature Drug Discovery 11, 763-776.
Miossec, P. et al. Targeting IL-17 and TH17 cells in chronic inflammation. Nat Rev Drug Discov. Oct. 2012;11(10):763-76. doi: 10.1038/nrd3794.
Mitropoulou, G. et al. Immobilization Technologies in Probiotic Food Production. (2013) Journal Nutr Metab. (2013) 716861.
Miyake, T. et al., Phylogenetic Analysis of the Genus Bifidobacterium and Related Genera Based on 16S rDNA Sequences. Microbiol. Immunol. 1998; 42(10):661-667.
Miyamoto-Shinohara et al. Survival of freeze-dried bacteria. J Gen Appl Microbiol 54(1):9-24 (2008).
Miyauchi, E., Control of multiple sclerosis by gut microbiota. Journal of clinical and experimental medicine. 2015. vol. 253 No. 5.2, pp. 445-450.
Monteleone et al., IL-10-dependent partial refractoriness to Toll-like receptor stimulation modulates gut mucosal dendritic cell function, European Journal of Immunology. 2008; 38(6):1533-1547.
Monteleone, I. et al., Th17-related cytokines: new players in the control of chronic intestinal inflammation. (2011) BMC Medicine. 2011, 9:122.
Mucientes, A. et al., Specific association of IL17A genetic variants with panuveitis. (2015) Br J Ophthalmol. 99(4):566-70.
Mukai et al., SH3BP2 Gain-of-Function Mutation Exacerbates Inflammation and Bone Loss in a Murine Collagen-Induced Arthritis Model, 2014 PLoS ONE 9(8): e105518.
Narushima, et al., Characterization of the 17 strains of regulatory T cell-inducing human-derived Clostridia. Gut Microbes Mar. 18, 2014; 5:3, 333-339.
Neish et al., TLRS in the Gut. II. Flagellin-induced inflammation and antiapoptosis, American Journal of Physiology-Gastrointestinal and Liver Physiology. 2007;292:G462-466.
Neville, B.A., Functional genomics of motile commensal intestinal bacteria. PhD Thesis. University College Cork. 2013. 281 Pages.
Neville, et al., Characterization of pro-inflammatory flagellin proteins produced by Lactobacillus ruminis and related motile Lactobacilli. PloS one. Jul. 2012;7(7):e40592.
Neyrinck et al. 'Dietary modulation of clostridial cluster XlVa gut bacteria (*Roseburia* spp.) by chitin-glucan fiber improves host metabolic alterations induced by high-fat diet in mice.' The Journal of Nutritional Biochemistry. 2012, vol. 23, No. 1, pp. 51-59.
Ng et al., Archaeal flagella, bacterial flagella and type IV pili: a comparison of genes and posttranslation modification, Journal of Molecular Microbiology and Biotechnology. 2006;11:167-191.
Notice of Allowance dated Feb. 3, 2016 for U.S. Appl. No. 14/349,907.
Notice of Allowance dated Mar. 6, 2017 for U.S. Appl. No. 14/249,710.
Notice of allowance dated Jun. 16, 2017 for U.S. Appl. No. 14/249,710.
Notice of allowance dated Sep. 1, 2017 for U.S. Appl. No. 15/357,850.
Notice of allowance dated Sep. 6, 2017 for U.S. Appl. No. 14/249,710.
Notice of Allowance dated Nov. 17, 2016 for U.S. Appl. No. 14/249,710.
Notice of Allowance dated Nov. 22, 2017 for U.S. Appl. No. 15/359,988.
Notice of Allowance dated Nov. 24, 2017 for U.S. Appl. No. 15/070,605.
Numasaki, M. et al., IL-17 Enhances the Net Angiogenic Activity and In Vivo Growth of Human Non-Small Cell Lung Cancer in SCID Mice through Promoting CXCR-2-Dependent Angiogenesis. (2005) J. Immunol. 175: 6177-6189.
Numasaki, M. et al., Interleukin-17 promotes angiogenesis and tumor growth. Blood. Apr. 1, 2003;101(7):2620-7. Epub Oct. 31, 2002.
Nutsch et al., T cell tolerance and immunity to commensal bacteria. Current Opinion in Immunology. Aug. 2012; 24 (4):385-391.
Office Action dated Jan. 2, 2018 for U.S. Appl. No. 15/357,936.
Office Action dated Jan. 11, 2005 for U.S. Appl. No. 10/285,224.
Office Action dated Jan. 26, 2009 for U.S. Appl. No. 10/275,706.
Office Action dated Feb. 18, 2010 for U.S. Appl. No. 10/285,224.
Office Action dated Mar. 13, 2013 for U.S. Appl. No. 12/760,926.
Office Action dated Mar. 26, 2007 for U.S. Appl. No. 10/275,706.
Office Action dated Apr. 4, 2008 for U.S. Appl. No. 10/285,224.
Office Action dated May 2, 2007 for U.S. Appl. No. 10/285,224.
Office Action dated May 2, 2008 for U.S. Appl. No. 10/275,706.
Office Action dated May 25, 2016 for U.S. Appl. No. 14/249,710.
Office Action dated May 26, 2009 for U.S. Appl. No. 10/285,224.
Office Action dated May 26, 2017 for U.S. Appl. No. 15/357,850.
Office Action dated May 30, 2006 for U.S. Appl. No. 10/285,224.
Office Action dated Jun. 26, 2017 for U.S. Appl. No. 15/357,936.
Office Action dated Jul. 6, 2017 for U.S. Appl. No. 15/070,605.
Office action dated Jul. 8, 2015 for U.S. Appl. No. 14/349,907.
Office Action dated Jul. 31, 2017 for U.S. Appl. No. 15/359,988.
Office Action dated Aug. 10, 2017 for U.S. Appl. No. 15/357,850.
Office Action dated Aug. 21, 2013 for U.S. Appl. No. 12/760,926.
Office Action dated Sep. 4, 2015 for U.S. Appl. No. 14/249,710.
Office Action dated Sep. 17, 2010 for U.S. Appl. No. 10/285,224.
Office Action dated Oct. 12, 2005 for U.S. Appl. No. 10/285,224.
Office Action dated Oct. 28, 2009 for U.S. Appl. No. 10/275,706.
Office Action dated Oct. 30, 2008 for U.S. Appl. No. 10/285,224.
Office Action dated Nov. 2, 2017 for U.S. Appl. No. 15/700,007.
Office Action dated Nov. 6, 2006 for U.S. Appl. No. 10/285,224.
Office Action dated Nov. 23, 2015 for U.S. Appl. No. 14/232,475.
Office Action dated Nov. 24, 2017 for U.S. Appl. No. 15/359,972.
Office Action dated Nov. 24, 2017 for U.S. Appl. No. 15/679,857.
Office Action dated Dec. 6, 2017 for U.S. Appl. No. 15/592,178.
Office Action dated Dec. 13, 2012 for U.S. Appl. No. 12/760,926.
Office Action dated Dec. 19, 2005 for U.S. Appl. No. 10/275,706.
Oladipo, et al., Bioprotective potential of bacteriocinogenic enterococcus gallinarum strains isolated from some Nigerian fermented foods, and of their bacteriocins. Polish Journal of Microbiology. 2014; 63(4): 415-422.
Olivera et al. 'Nutritional and physiological responses of young growing rats to diets containing raw cowpea seed meal, protein isolate (globulins), or starch.' Journal of agricultural and food chemistry. 2003, vol. 51, No. 1, pp. 319-325.

(56) References Cited

OTHER PUBLICATIONS

Overstreet et al. 'Dysbiosis Characterized by Reduced Abundance of Roseburia is Associated With Increased Severity of Colitis in IL-10-/- Mice'. Gastroenterology. 2011, vol. 140, No. 5, Suppl. 1, pp. S-696.
Pace et al. Macrophage activiation: Priming activity from a T-cell hybridoma is attributable to interferon. (1983) PNAS. 80:3782-6.
Parabacteroides distasonis (Eggerth and Gagnon) Sakamoto and Benno (ATCC 8503). Sep. 19, 2017. 2 Pages.
Park, S.K. et al., *Blautia stercoris* sp. nov., isolated from human faeces. International journal of systematic and evolutionary microbiology. 2012; 62(4): 776-779.
Patel., R. et al., Determination of 16S rRNA sequences of enterococci and application to species identification of nonmotile enterococcus gallinarum isolates. Journal of clinical microbiology, 1998; 36(11):3399-3407.
Peterson et al. 'Catecholamines increase conjugative gene transfer between enteric bacteria.' Microbial Pathogensis. 2011, vol. 51, No. 1, pp. 1-8.
Polak J.M. and McGee J.O., In Situ Hybridization: Principles and Practice, Oxford University Press. 1990; pp. vii-viii.
Potrykus (1991) "Gene Transfer to Plants: Assessment of Published Approaches and Results," Annu. Rev. Plant Physiol. Plant Mol. Bioi. 42:205-225.
Prakash, et al., Complete genome sequences of rat and mouse segmented filamentous bacteria, a potent inducer of th17 cell differentiation. Cell Host & Microbe. Sep. 2011;10(3):273-284.
Pryde et al. 'The microbiology of butyrate formation in the human colon.' FEMS Microbiology Letters. 2002. vol. 217,No. 2, pp. 133-139.
Punt et al. (2002) "Filamentous fungi as cell factories for heterologous protein production," Trends Biotechnol. 20 (5):200-206.
Qin et al. 'A human gut microbial gene catalogue established by metagenomic sequencing.' Nature. 2010, vol. 464, No. 7285, pp. 59-65.
Reiff,C. and Kelly,D.,Inflammatory bowel disease, gut bacteria and probiotic therapy. International journal of medical microbiology, 2010;300:25-33.
Rhee et al.,Toll-Like Receptor 5 Engagement Modulates Tumor Development and Growth in a Mouse Xenograft Model of Human Colon Cancer. Gastroenterology. Aug. 2008;135(2):518-528.
Rockwell, S.C. et al., Characteristics of a Serially Transplanted Mouse Mammary Tumor and Its Tissue-Culture-Adapted Derivative. (1972) J Natl Cancer Inst. 49:735-49.
Roe, et al., DNA Isolation and Sequencing: Essential Techniques. John Wiley & Sons, New York, New York. 1996; pp. v-vii.
Round et al. 'The Toll-like receptor 2 pathway establishes colonization by a commensal of the human microbiota.' Science. 2011, vol. 332, No. 6032, pp. 974-977.
Rudinger et al., Characteristics of the amino acids as components of a peptide hormone sequence. Peptide Hormones. Biol. Council. Jun. 1976; 10 Pages.
Russell et al. 'High-protein, reduced-carbohydrate weight-loss diets promote metabolite profiles likely to be detrimental to colonic health.' The American Journal of Clinical Nutrition. 2011, vol. 93, No. 5, pp. 1062-1072.
Sagar, et al., Bifidobacterium breve and lactobacillus rhamnosus treatment is as effective as budesonide at reducing inflammation in a murine model for chronic asthma. Respiratory Research. 2014; 15(46):1-17.
Sakamoto, M. et al., Reclassification of Bacteroides distasonis, Bacteroides goldsteinii and Bacteroides merdae as *Parabacteroides distasonis* gen. nov., comb. nov., *Parabacteroides goldsteinii* comb. nov. and *Parabacteroides merdae* comb. nov. International journal of systematic and evolutionary microbiology. 2006; 56: 1599-1605.
Salminen et al. 'Probiotics: how should they be defined?.' Trends in Food Science & Technology. 1999, vol. 10, No. 3, pp. 107-110.
Salonen et al., Gastrointestinal microbia in irritable bowel syndrome: present state and perspectives. Microbiology. 2010; 156: 3205-3215.

Sambrook, J.F. et al., Molecular Cloning: A Laboratory Manual, 3rd ed. Cold spring harbor laboratory press. 2001.
Scanlan PD., et al., Culture-independent analyses of temporal variation of the dominant fecal microbiota and targeted bacterial subgroups in Crohn's disease. J Clin Microbiol. Nov. 2006;44(11):3980-8. Epub Sep. 20, 2006.
Scher et al., Expansion of intestinal Prevotella copri correlates with enhanced susceptibility to arthritis. 2013; eLIFE 2, e01202, 20 Pages.
Schieck, M. et al., Genetic variation in TH17 pathway genes, childhood asthma, and total serum IgE levels.(2014) J Allergy Clin Immunol. 133(3):888-91.
Schleifer, K.H. et al., Transfer of *Streptococcus faecalis* and *Streptococcus faecium* to the Genus *Enterococcus* nom. rev. as *Enterococcus faecalis* comb. nov. and *Enterococcus faecium* comb. nov. Int J Syst Evol Microbiol, Jan. 1984 34: 31-34, doi:10.1099/00207713-34-1-31.
Schmitz, S. et al., A prospective, randomized, blinded, placebo-controlled pilot study on the effect of Enterococcus faecium on clinical activity and intestinal gene expression in canine food-responsive chronic enteropathy. J Vet Intern Med. Mar.-Apr. 2015;29(2):533-43. doi: 10.1111/jvim.12563. Epub Mar. 16, 2015.
Schouten, et al., Cow milk allergy symptoms are reduced in mice fed dietary synbiotics during oral sensitization with whey. Nutritional Immunology. 2015; 139(7):1390-403.
Schulke et al. (Aug. 26, 2011) "A fusion protein of ftagellin and ovalbumin suppresses the 25 TH2 response and prevents murine intestinal allergy," The Journal of Allergy and Clinical Immunology. 128(6):1340-1348.
Schwiertz, et al., Quantification of Different *Eubacterium* spp. in Human Fecal Samples with Species-Specific 16S rRNA-Targeted Oligonucleotide Probes. Applied and environmental biology, vol. 66, No. 1, Jan. 1, 2000; pp. 375-382.
Scott et al. 'Substrate-driven gene expression in Roseburia inulinivorans: importance of inducible enzymes in the utilization of inulin and starch.' Proceedings of the National Academy of Sciences. 2011, vol. 108, Supp. 1, pp. 672-4679.
Sczesnak, et al., The genome of th17 cell-inducing segmented filamentous bacteria reveals extensive auxotrophy and adaptations to the intestinal environment. Cell Host Microbe. Sep. 2011;10 (3):260-272.
Severijnen, et al., Chronic Arthritis Induced in Rats by Cell Wall Fragments of *Eubacterium* Species from the Human Intestinal Flora. Infection and Immunity, Feb. 1990; 58(2): p. 523-528.
Sgadari, C. et al., Interferon-inducible protein-10 identified as a mediator of tumor necrosis in vivo. (1996) PNAS. 93:13791-6.
Sgadari et al. Mig, The Monokine Induced by Interferon-g, Promotes Tumor Necrosis In Vivo. (1997) Blood. 89:2635-43.
Shabgah, A.G. et al., Interleukin-17 in human inflammatory diseases. Postepy Dermatol Alergol. Aug. 2014; 31(4): 256-261.
Shevach et al., Current Protocols in Immunology. John Wiley & Sons. New York, New York. 1992. Table of Contents only, as accessed online at URL: http://www.4ulr.com/products/currentprotocols/immunology_toc.html. [Last Accessed Jun. 18, 2015].
Simpson-Herren, L. et al., Kinetic parameters and growth curves for experimental tumor systems. Cancer Chemother Rep. Jun. 1970;54(3):143-74.
Sisson, G. et al., Randomised clinical trial: a liquid multi-strain probiotic vs. placebo in the irritable bowel syndrome—a 12 week double-blind study. Aliment Pharmacol Ther. 2014; 40: 51-62.
Sivieri, K. et al., Probiotic enterococcus faecium CRL 183 inhibit chemically induced colon cancer in male wistar rats. Eur Food Res Technol. 2008; 228:231-237.
Skountzou, et al., *Salmonella flagellins* are potent adjuvants for intranasally administered whole inactivated influenza vaccine. Vaccine. May 2010; 28(24):4103-4112.
Smith, T.F. et al., Comparison of biosequences. (1981) Adv. Appl. Math. 2: 482-489.
Sokol et al. 'Faecalibacterium prausnitzii is an anti-inftammatory commensal bacterium identified by gut microbiota analysis of Crohn disease patients.' Proceedings of the National Academy of Sciences. 2008, vol. 105, No. 43, pp. 6731-16736.

(56) References Cited

OTHER PUBLICATIONS

Sokol et al. 'Low counts of Faecalibacterium prausnitzii in colitis microbiota.' Inflammatory bowel diseases. 2009, vol. 15, No. 8, pp. 1183-1189.
Song et al., Impact of Schistosoma japonicum Infection on Collagen-Induced Arthritis in DBA/1 Mice: A Murine Model of Human Rheumatoid Arthritis. 2011; PLoS ONE 6, e23453, 10 pAGES.
Spor, A. et al., Unravelling the effects of the environment and host genotype on the gut microbiome. Nat Rev Microbiol. Apr. 2011;9(4):279-90. doi: 10.1038/nrmicro2540.
Srutkova, D. et al., Efficiency of PCR-based methods in discriminating *Bifidobacterium longum* ssp. *longum* and *Bifidobacterium longum* ssp. infantis strains of human origin.J Microbiol Methods. Oct. 2011;87(1):10-6. doi: 10.1016/j.mimet.2011.06.014. Epub Jul. 2, 2011.
Stanton et al. (1983) "*Roseburia cecicola* gen. nov., sp. nov., a Motile, Obligately Anaerobic Bacterium from a Mouse Cecum," Int. J. Syst. Bacterial. 33:618-627.
Stoll et al., Altered microbiota associated with abnormal humoral immune responses to commensal organisms in enthesitis-related arthritis, 2014; Arthritis Res Ther. 16:486.
Strickertsson, J.A. et al., Enterococcus faecalis Infection and Reactive Oxygen Species Down-Regulates the miR-17-92 Cluster in Gastric Adenocarcinoma Cell Culture. Genes 2014, 5(3), 726-738.
Strobel, H.J. Basic laboratory culture methods for anaerobic bacteria. Methods Mol Biol. 2009;581:247-61. doi: 10.1007/978-1-60761-214-8_16.
Sun, D. et al., The role of Th17-associated cytokines in the pathogenesis of experimental autoimmune uveitis (EAU). (2015) Cytokine. 74(1):76-80.
Tamanai-Shacoori, et al., *Roseburia* spp.: a marker of health?. Future Microbiology Review 12(2), 157-170 (2017).
Tanaka, K. and Watanabe, K., In Vitro tebipenem activity against anaerobic bacteria. Japanese Journal of Chemotherapy. Mar. 2009. vol. 57 S-1.
Tatusova, et al., Erratum to BLAST 2 Sequences, a new tool for comparing protein and nucleotide sequences [FEMS Microbiol. 174 (1999) 247-250], FEMS Microbial. Lett. 1999;177(1):187-188.
Tatusova et al. (1999) "BLAST 2 Sequences, a new tool for comparing protein and nucleotide sequences," FEMS Microbial. Lett. 174(2):247-250.
Tesmer, LA. et al., Th17 cells in human disease. Immunol Rev. 2008;223:87-113.
Tilg, et al., Roseburia hominis: a novel guilty player in ulcerative colitis pathogenesis? Gut, Oct. 14, 2013;63(8)1204-1205.
Toomer, O. et al., Maternal and postnatal dietary probiotic supplementation enhances splenic regulatory T helper cell population and reduces peanut allergen-induced hypersensitivity responses in mice. Immunobiology. 209; 2014: 661-670.
Travis, et al. Complete genome sequence of the human gut symbiont Roseburia hominis. Genome announcements. 2015; 3(6):e01286-15.
Tremaroli, et al., A role for the gut microbiota in energy harvesting? Gut. Dec. 2010; 59(12):1589-1590.
Trueman (1995) "Heterologous Expression in Yeast," Methods Molecular Biology. 49:341-354.
Tsukinowa, et al., Fecal microbiota of a dugong (Dugong dugong) in captivity at Toba Aquarium. J. Gen. Appl. Microbiol., 54, 25-38 (2008).
Turnbaugh, et al., An obesity-associated gut microbiome with increased capacity for energy harvest. Nature. Dec. 2006;444(7122):1027-1031.
Turnbaugh et al., Diet-induced obesity is linked to marked but reversible alterations in the mouse distal gut microbiome. Cell Host & Microbe. Apr. 2008;3(4):213-223.
Turner (1994) "Vectors for genetic manipulation," In; Martinelli, S.D.; Kinghorn J. R.: Eds. Aspergillus: 50 years on. Progress in industrial microbiology. vol. 29. Elsevier. Amsterdam, The Netherlands. pp. 641-666.

Udayappan, et al., Oral treatment with Eubacterium hallii improves insulin sensitivity in db/db mice. NPJ Biofilms and microbiomes, vol. 2, Jul. 6, 2016; p. 16009.
Udayappan et al., PS4-5. Administration of Eubacterium hallii improves insulin sensitivity and degree of liversteatosis in male db/db mice. Nederlands tijdschrift voor diabetologie, vol. 11, No. 4., Nov. 23, 2013.pp. 145.
Ukena, et al., Probiotic *Escherichia coli* Nissle 1917 inhibits leaky gut by enhancing mucosal integrity, PloS one. Dec. 2007;2(12):e1308.
Untergasser, et al., Primer3Plus, an enhanced web interface to Primer3, Nucleic Acids Res. 2007;35(Web Server issue):W71-W74.
U.S. Appl. No. 15/359,988 Notice of Allowance dated Mar. 2, 2018.
U.S. Appl. No. 15/359,988 Notice of Allowance dated Mar. 16, 2018.
U.S. Appl. No. 15/631,952 Office Action dated Feb. 16, 2018.
U.S. Appl. No. 15/679,857 Office Action dated Feb. 14, 2018.
U.S. Appl. No. 15/803,723 Notice of Allowance dated Feb. 13, 2018.
Van De Veerdonk, et al., The Anti-CD20 antibody rituximab reduces the Th17 cell response. Arthritis & Rheumatism. Jun. 2011; 63(6):1507-1516.
Van Immerseel et al. 'Butyric acid-producing anaerobic bacteria as a novel probiotic treatment approach for inflammatory bowel disease.' Journal of medical microbiology. 2010, vol. 59, No. 2, pp. 141-143.
Vetrovsky, T. and Baldrian, P., The variability of the 16S rRNA gene in bacterial genomes and its consequences for bacterial community analyses. Plos One. Feb. 2013; 8(2): e57923.
Vijay-Kumar, et al., Deletion of TLR5 results in 10 spontaneous colitis in mice. The Journal of Clinical Investigation. Dec. 2007;117(12):3909-3921.
Vijay-Kumar et al., Flagellin Treatment Protects against Chemicals, Bacteria, Viruses, and Radiation. The Journal of Immunology. 2008;180(12):8280-8285.
Walker et al. 'Dominant and diet-responsive groups of bacteria within the human colonic microbiota.' The ISME Journal. 2010, vol. 5, No. 2, pp. 220-230.
Watson, et al., Signal transduction in Campylobacter jejuni-induced cytokine production. Cellular Microbiology. 2005;7(5):655-665.
Weigel, et al., Comparative analysis of murine marrow-derived dendritic cells generated by Flt3L or GMCSF/IL-4 and matured with immune stimulatory agents on the in vivo induction of antileukemia responses. Blood. Dec. 2002;100(12):4169-4176.
Werth, et al., The transcription factor grainyhead-like 2 regulates the molecular composition of the epithelial apical junctional complex. Development. 2010;37(22):3835-3845.
Wilson, et al., The TLR5 ligand flagellin promotes asthma by priming allergic responses to indoor allergens. Nature Medicine. Nov. 2012;18(11):1705-1710.
Workman et al. Guidelines for the welfare and use of animals in cancer research (2010) Br. J. Cancer. 102:1555-77.
Wunderlich, P.F. et al., Double-blind report on the efficacy of lactic acid-producing enterococcus SF68 in the prevention of antibiotic-associated diarrhoea and in the treatment of acute diarrhoea. The journal of international medical research. 1989; 17: 333-338.
Xu, et al., Differential development of murine dendritic cells by GM-CSF versus Flt3 ligand has implications for inflammation and trafficking. J. Immunology. 2007;179(11):7577-7584.
Yang, J. et al., Targeting Th17 cells in autoimmune diseases. Trends Pharmacol Sci. Oct. 2014;35(10):493-500. doi: 10.1016/j.tips.2014.07.006. Epub Aug. 14, 2014.
Ye, X. et al., The Role of IL-23/Th17 Pathway in Patients with Primary Immune Thrombocytopenia. (2015) PLoS One. 10(1):e0117704.
Yin, X. et al., Combined effect of five single nucleotide polymorphisms related to IL23/Th17 pathway in the risk of psoriasis. Immunogenetics. Mar. 2014;66(3):215-8. doi: 10.1007/s00251-013-0756-2. Epub Jan. 14, 2014.
Yoon, et al., Structural basis of TLR5-flagellin recognition and signaling. Science. Feb. 2012; 335(6070):859-864.
Yutin, N. and Galperin, M.Y., A genomic update on clostridial phylogeny:Gram-negative spore formers and other misplaced clostridia. Environmental microbiology. 20136; 15(10): 2631-2641.

(56) References Cited

OTHER PUBLICATIONS

Zhang, B. et al., Oral administration of enterococcus faecalis FK-23 suppresses Th17 cell development and attenuates allergic airway responses in mice. International journal of molecular medicine. 2012; 30:248-254.
Zhang, B. et al., The Prevalence of Th17 Cells in Patients With Gastric Cancer. 2008. Biochem Biophys Res Commun 374 (3), 533-537.
Zhang, et al., The Activation of NF-κB in Infiltrated Mononuclear Cells Negatively Correlates with Treg Cell Frequency in Oral Lichen Planus. Inflammation. Aug. 2015;38(4):1683-9. doi: 10.1007/s10753-015-0145-x.
Zheng, B. et al., Bifidobacteriu breve attenuates murine dextran sodium sulfate-induced colitis and increases regulatory T cell responses. PLOS one. May 2014; 9(5).
Zhongyuan, T. et al., The inflammation regulation effects of enterococcus faecium HDRsEf1 on human enterocyte-like HT-29 cells. Animal cells and systems. Mar. 2016;20(2):70-76.
Zhu, S. and Qian, Y., IL-17/IL-17 receptor system in autoimmune disease: mechanisms and therapeutic potential. Clinical Science (2012) 122, 487-511.
Zitomersky, N. et al., Characterization of Adherent Bacteroidales from Intestinal Biopsies of Children and Young Adults with Inflammatory Bowel Disease. PLOS one. 2013; 8(6).
Zitvogel, et al., Type I interferons in anticancer immunity. Nature Reviews. Jul. 2015:405-414.
Co-pending U.S. Appl. No. 15/915,885, filed Mar. 8, 2018.
Co-pending U.S. Appl. No. 15/915,889, filed Mar. 8, 2018.
Co-pending U.S. Appl. No. 15/916,167, filed Mar. 8, 2018.
Co-pending U.S. Appl. No. 15/916,202, filed Mar. 8, 2018.
Co-pending U.S. Appl. No. 15/916,205, filed Mar. 8, 2018.
Buffie et al., Precision microbiome restoration of bile acid-mediated resistance to Clostridium difficile. Nature, 517(7533):205-208 (2015).
Colin, et al., GIC-1001, A Clinical Stage, Orally Administered Colonic Analgesic Drug Proposed as a Cost-Effective Alternative to I.V. Sedation Used in Colonoscopy. Canadian Digestive Diseases Week, 2014; 2 pages.
Co-pending U.S. Appl. No. 16/022,207, filed Jun. 28, 2018.
Co-pending U.S. Appl. No. 16/022,256, filed Jun. 28, 2018.
Co-pending U.S. Appl. No. 16/022,484, filed Jun. 28, 2018.
Co-pending U.S. Appl. No. 16/022,577, filed Jun. 28, 2018.
Co-pending U.S. Appl. No. 16/031,024, filed Jul. 10, 2018.
Co-pending U.S. Appl. No. 16/040,356, filed Jul. 19, 2018.
Co-pending U.S. Appl. No. 16/100,349, filed Aug. 10, 2018.
Co-pending U.S. Appl. No. 16/147,551, filed Sep. 28, 2018.
Distrutti, et al., 5-Amino-2-hydroxybenzoic Acid 4-(5-Thioxo-5H-[1,2]dithiol- 3yl)-phenyl Ester (ATB-429), a Hydrogen Sulfide-Releasing Derivative of Mesalamine, Exerts Antinociceptive Effects in a Model of Postinflammatory Hypersensitivity. The Journal of pharmacology and experimental therapeutics, 2006;319(1):447-458.
Farmer, et al., Gut pain & visceral hypersensitivity. British journal of pain, 2013;7(1):39-47.
GB1809729.5 Examination Report dated Oct. 15, 2018.
U.S. Appl. No. 15/631,945 Notice of Allowance dated Oct. 18, 2018.
U.S. Appl. No. 15/700,007 Notice of Allowance dated Oct. 17, 2018.
U.S. Appl. No. 15/631,945 Office Action dated Jul. 5, 2018.
U.S. Appl. No. 15/631,952 Office Action dated Jul. 19, 2018.
U.S. Appl. No. 15/679,857 Office Action dated Aug. 6, 2018.
U.S. Appl. No. 15/704,245 Office Action dated Sep. 17, 2018.
Van Tilburg, M. Can we treat visceral hypersensitivity in functional abdominal pain? Lancet Gastroenterolhepatol, 2017; 2 Pages.
Jan. 17, 2019 First Office Action for CN201680041407.6 (Translated).
Jan. 17, 2019 Notice of Allowance for U.S. Appl. No. 15/803,721.
Dec. 21, 2018 Notice of Allowance U.S. Appl. No. 15/700,700.
Jan. 30, 2019 Notice of Corrected Allowability for U.S. Appl. No. 15/803,721.
Jan. 30, 2019 Final Rejection for U.S. Appl. No. 15/842,635.
Feb. 1, 2019 Non-Final Office Action U.S. Appl. No. 16/040,356.
Mar. 4, 2019 Final Office Action for U.S. Appl. No. 15/704,245.
4D Pharma:"4Dpharma PLC clinical update on blautix (TM), a novel treatment to irritable bowel syndrome," 4DPharma, Jan. 19, 2016, XP002769874, Retrieved from: https://www.directorstalkinterviews.com/4d-pharma-plc-clinical-update-on-blautix-a-novel-treatment-for-irritable-bowel-syndrome/412689588. [Retrieved on May 5, 2017].
Ahanchian, Hamic, A multi-strain synbiotic may reduce viral respiratory infections in asthmatic children: a randomized controlled trial; Sep. 2016, vol. 8, Issue 9, pp. 2833-2839, DOI: http://dxdoi.or/10.19082/2833.
Alp, G., and Aslim, B. (2010). Relationship between the resistance to bile salts and low pH with exopolysaccharide (EPS) production of *Bifidobacterium* spp. isolated from infants feces and breast milk. Anaerobe 16(2), 101-105. doi: 10.1016/j.anaerobe.2009.06.006.
Appleyard, Caroline B. et al., Pretreatment with the probiotic VSL#3 delays transition from inflammation to dysplasia in rate model of colitis-associated cancer; Am J. Physiol. Gastrointest. Liver Physiol. 301:G1004-G1013, 2011, Sep. 8, 2011:DOI:10.1152.ajpg.00167.2011.
Awadel-Kariem, Mustafa et al., First report of Parabacteroides goldsteinii bacteraemia in a patient with complicated intra-abdominal infection, Anaerobe, vol. 16, Issue 3, Jun. 2010, pp. 223-225.
Aziz, R.K., Bartels, D., Best, A.A., DeJongh, M., Disz, T., Edwards, R.A., et al. (2008). The RAST Server: Rapid Annotations using Subsystems Technology. BMC Genomics 9, 75. doi: 10.1186/1471-2164-9-75.
Beaucage, et al. Deoxynucleoside phosphoramidites—A new class of key intermediates for deoxypolynucleotide synthesis. Tetrahedron Letters, vol. 22, 1981, pp. 1859-1869.
Begley, M., Hill, C., and Gahan, C.G.M. (2006). Bile Salt Hydrolase Activity in Probiotics. Applied and Environmental Microbiology 72(3), 1729-1738. doi: 10.1128/AEM.72.3.1729-1738.2006.
Berger, B., Moine, D., Mansourian, R., and Arigoni, F. (2010). HspR Mutations Are Naturally Selected in Bifidobacterium longum When Successive Heat Shock Treatments Are Applied. Journal of Bacteriology 192(1), 256-263. doi: 10.1128/jb.01147-09.
Berger, S. Gideon guide to medically important bacteria. Gideon E-book Series. 2017 edition. 4 pages.
Bergonzelli, G.E., Granato, D., Pridmore, R.D., Marvin-Guy, L.F., Donnicola, D., and Corthesy-Theulaz, I.E. (2006). GroEL of Lactobacillus johnsonii La1 (NCC 533) is cell surface associated: potential role in interactions with the host and the gastric pathogen Helicobacter pylori. Infect Immun 74(1), 425-434. doi: 10.1128/IAI.74.1.425-434.2006.
Bernalier, A., et al., "Diversity of H2/C02-utilizing acetogenic Bacteria from Feces of Non-Methane-Producing Humans", Current Microbiology vol. 33 (Aug. 1996), pp. 94-99, Springer-Vertag New York Inc., USA.
Bernalier et al., "Acetogenesis from H02 and C0-2 by Methane and Non-Methane-Producing Human Colonic Bacterial Communities" Fems Microbiology Ecology. vol. 19. No. 3. 1996. pp. 193-202. XP000979130.
Blandino, G., Fazio, D., DiMarco, R. Probiotics: Overview of microbiological and immunological characteristics (2008). Expert Review of Anti-Infective Therapy, 6 (4), pp. 497-508.
Bond, John H., Jr., et al., "Factors Influencing Pulmonary Medicine Excretion in Man: An indirect method of studying the in situ metabolism of the methane-producing colonic bacteria"; Journal of Experimental Medicine, Oct. 29, 1970, pp. 572-388.
Born, P., et al., English Abstract "Carbohydrate substitutes: comparative study of intestinal absorption of fructose, sorbitol and xylitol", "Zuckeraustauschstoffe: Vergleichende Untersuchung zur intestinalen Resorption von Fructose, Sorbit and Xylit", Medizinische Klinik 89, Technischen Universitat Munchen (Munich) Nov. 15, 1994; 89 (11): 575-8 (Article in German), Urban & Vogel, Munich, Germany.
Born, P., et al., "Fecal bacterial activity in symptomatic carbohydrate malabsorption: Effect on the fecal short-chain fatty acid ratio", intervention during the week "Digestive Diseases Week" from May

(56) References Cited

OTHER PUBLICATIONS 16 to May 19, 1999, Orlando, Z. Gasteroenterol2000: 38:623-626, Georg Thieme Verlag Stuttgart, New York, USA.
Bottacini, F., Morrissey, R., Esteban-Torres, M., James, K., van Breen, J., Dikareva, E., et al. (2018). Comparative genomics and genotype-phenotype associations in Bifidobacterium breve. Scientific Reports 8(1), 10633. doi: 10.1038/s41598-018-28919-4.
Bottacini, F., O'Connell Motherway, M., Kuczynski, J., O'Connell, K.J., Serafini, F., Duranti, S., et al. (2014). Comparative genomics of the Bifidobacterium breve taxon. BMC Genomics 15(1), 170. doi: 10.1186/1471-2164-15-170.
Bry et al. A model of host-microbial interactions in an open mammalian ecosystem. Science 273(5280):1380-1383 (1996).
Candela et al. 'Interaction of probiotic Lactobacillus and Bifidobacterium strains with human intestinal epithelial cells:Adhesion properties, competition against enteropathogens and modulation of IL-8 production'. International Journal of Food Microbiology. 2008, vol. 125, No. 3, pp. 286-292.
Candela, M., Bergmann, S., Vici, M., Vitali, B., Turroni, S., Eikmanns, B.J., et al. (2007). Binding of human plasminogen to Bifidobacterium. J Bacteriol 189(16), 5929-5936. doi: 10.1128/JB.00159-07.
Candela, M., Biagi, E., Centanni, M., Turroni, S., Vici, M., Musiani, F., et al. (2009). Bifidobacterial enolase, a cell surface receptor for human plasminogen involved in the interaction with the host. Microbiology 155(Pt 10), 3294-3303. doi: 10.1099/mic.0.028795-0.
Candela, M., Centanni M Fau—Fiori, J., Fiori J Fau—Biagi, E., Biagi E Fau—Turroni, S., Turroni S Fau—Orrico, C., Orrico C Fau—Bergmann, S., et al. (2010). DnaK from Bifidobacterium animalis subsp. lactis is a surface-exposed human plasminogen receptor upregulated in response to bile salts. Microbiology 156(6), 1609-1618.
Caruthers, et al. New chemical methods for synthesizing polynucleotides. Nucleic Acids Symp Ser. 1980;(7):215-23.
Casey et al. 'Isolation and characterization of anti-Salmonella lactic acid bacteria from the porcine gastrointestinal tract'. Letters in Applied Microbiology. 2004, vol. 39, No. 5, pp. 431-438.
Christiaen, S.E., O'Connell Motherway, M., Bottacini, F., Lanigan, N., Casey, P.G., Huys, G., et al. (2014). Autoinducer-2 plays a crucial role in gut colonization and probiotic functionality of Bifidobacterium breve UCC2003. PLoS One 9(5), e98111. doi: 10.1371/journal.pone.0098111.
Cintas LM, Casaus MP, Herranz C, Nes IF, Hernandez PE. Review: bacteriocins of lactic acid bacteria (2001). Food Sci Technol 7(4):281-305.
Claesson, et al. Gut microbiota composition correlates with diet and health in the elderly. 2012. Nature, 488, 178-184.
Claims to be granted in European Application No. 15817513.3.
Clarridge III, J.E. Impact of 16S rRNA gene sequence analysis for identification of bacteria on clinical microbiology and infectious diseases (2004). Clinical Microbiology Reviews, 17 (4), pp. 840-862.
Clinical Trials for Thetanix, EU Clinical Trials Register, Date of commencement of clinical trial: Oct. 16, 2015. Available at: https://clinicaltrialsregister.eu/ctr-search/search?query=Thetanix.
CN Office Action dated Jan. 17, 2019, for CN 201680041407.6 (translation not yet available).
Constantinescu et al. Experimental autoimmune encephalomyelitis (EAE) as a model for multiple sclerosis (MS). 2011. Br J Pharmacol. 164(4):1079-1106.
Co-pending U.S. Appl. No. 16/206,250, filed Nov. 30, 2018.
Co-pending U.S. Appl. No. 16/219,667, filed Dec. 18, 2018.
Co-pending U.S. Appl. No. 16/240,644, filed Jan. 4, 2019.
Co-pending U.S. Appl. No. 16/247,834, filed Jan. 15, 2019.
Co-pending U.S. Appl. No. 16/248,857, filed Jan. 16, 2019.
Co-pending U.S. Appl. No. 16/251,462, filed Jan. 18, 2019.
Co-pending U.S. Appl. No. 16/265,238, filed Feb. 1, 2019.
Cotter, P.O., Hill, C., Ross, R.P. Food microbiology: Bacteriocins: Developing imlate immunity for food (2005). Nature Reviews Microbiology, 3 (10), pp. 777-788.

Cronin, M., Knobel, M., O'Connell-Motherway, M., Fitzgerald, G.F., and van Sinderen, D. (2007). Molecular Dissection of a Bifidobacterial Replicon. Applied and Environmental Microbiology 73(24), 7858-7866.
Cummings, M., Breitling, R., and Takano, E. (2014). Steps towards the synthetic biology of polyketide biosynthesis. Fems Microbiology Letters 351(2), 116-125. doi: 10.1111/1574-6968.12365.
Darfeuille-Michaud et al. High prevalence of adherent-invasive Escherichia coli associated with ileal mucosa in Crohn's disease. . 2004. Gastroenterology 127(2):412-21.
Database UniProt [Online] Jun. 1, 2003 (Jun. 1, 2003), "subname:Full= possible pirin family protein {ECO:0000313|EMBL:AAO75294. 1};", XP00275366,retrieved from EBI accession No. UNIPROT:Q8ABC3 Database accession No. Q8ABC3.
Davis et al. (1971) "Genetic and Microbiological Research Technqiues," Methods Enzymol. 17A:79-143.
De Ruyter, P.G., Kuipers, O.P., and de Vos, W.M. (1996). Controlled gene expression systems for Lactococcus lactis with the food-grade inducer nisin. Applied and Environmental Microbiology 62(10), 3662-3667.
Deangelis, M., et al., Selection of potential probiotic lactobacilli from pig feces to be used as additives in pelleted feeding (2006). Research in Microbiology, 157 (8), pp. 792-801.
Delgado, S., Ruiz, L., Hevia, A., Ruas-Madiedo, P., Margolles, A., and Sánchez, B. (2018). "Evidence of the In Vitro and In Vivo Immunological Relevance of Bifidobacteria," in the Bifidobacteria and Related Organisms.), 295-305.
Distrutti, et al., Hydrogen sulphide induces u opioid receptor-dependent analgesia in a rodent model of visceral pain. Molecular Pain, 2010; 6(36):1-16.
DMSZ: Opening of Ampoules and Rehydration of Dried Cultures; (http://web.archive.org/web/20000 52411541 O/www.dsmz.de/open. htm); updated of website on Mar. 2000.
Dong, H., Rowland I Fau—Yacioob, P., and Yacioob, P. (2012). Comparative effects of six probiotic strains on immune function in vitro. Br J Nutr 108(3), 459-470. doi: 10.1017/S0007114511005824.
Drago, Lorenzo et al., Immunodulatory Effects of Lactobucillus salivarius LS01 and Bifidobacterium breve, Alone and in Combination on Peripheral Blood Mononuclear Cells of Allergic Asthmatics; Allergy Asthma Immunol. Res. Jul. 2015: 7(4):409-413.
Duncan, et al. Roseburia intestinalis sp. nov., a novel saccharolytic, butyrate-producing bacterium from human faeces. Int J Syst Evol Microbiol. Sep. 2002;52(Pt 5):1615-20.
Durand et al., "Reductive Acetogenesis in Animal and Human Gut." Physiological and Clinical Aspects of Short-Chain Fatty Acids, 1995. pp. 107-117, XP000979817 Cambridge University Press ISBN 0-521-44048-3.
Elhenawy et al., Preferential packing of acidic glycosidases and proteases into bacteroides Outer membrane vesicles. mBio 5:e00909-14, pp. 1-12, 2014.
Elmadfa, I., Klein, P., Meyer, AL. Immune-stimulating effects oflactic acid bacteria in vivo and in vitro (2010). Proceedings of the Nutrition Society, 69 (3), pp. 416-420.
Embl sequence AAO75294.1 (2003)—provided within the Office Action dated Feb. 16, 2018 in U.S. Appl. No. 15/631,952. 2 Pages.
Eren, A. Murat et al., "A single genus in the gut microbiome reflects host preference and specificity," The ISME Journal (2015) 9, 9-100 (2015).
ESR dated Dec. 17, 2018, Appl. 18189521.0.
Estelle Devillard et al., Metabolism of Linoleic Acid by Human Gut Bacteria: Different Routes for Biosynthesis of Conjugated Linoleic Acid, Journal of Bacteriology, Mar. 2007, vol. 189, No. 4, pp. 2566-2570.
European Communication dated Jun. 14, 2017 for EP Application No. 15817513.3.
Evelo Biosciences, Inc. Clinical Trials (Rank 1): A Study of EDP1503 in Patients With Colorectal Cancer, Breast Cancer, and Checkpoint Inhibitor Relapsed Tumors, https://clinicaltrials.gov/ct2/show/NCT03775850?spons=evelo&rank=1.
Evelo Biosciences, Inc. Clinical Trials (Rank 2): A Study of EDP1815 in Healthy Participants and Participants With Mild to Moderate Psoriasis and Atopic Dermatitis, https://clinicaltrials.gov/ct2/show/NCT03733353?spons=evelo&rank=2.

(56) References Cited

OTHER PUBLICATIONS

Evelo Biosciences, Inc. Clinical Trials (Rank 3): A Study of EDP1066 in Healthy Participants and Participants With Mild to Moderate Psoriasis and Atopic Dermatitis, https://clinicaltrials.gov/ct2/show/NCT03542994?spons=evelo&rank=3.
Evelo Biosciences, Inc. Clinical Trials (Rank 4): Pembrolizumab and EDP1503 in Advanced Melanoma, https://clinicaltrials.gov/ct2/show/NCT03595683?spons=evelo&rank=4.
Evelo Biosciences, Inc. Portfolio: https://evelobio.com/portfolio/.
Evelo Biosciences, Inc. website: https://evelobio.com/science/.
Faith et al. Identifying gut microbe-host phenotype relationships using combinatorial communities in gnotobiotic mice. Sci Transl Med 6(220):220ra11 (2014).
Faith et al. The long-term stability of the human gut microbiota. 2013. Science, 341(6141): 1237439.
Fanning, S., Hall, L.J., Cronin, M., Zomer, A., MacSharry, J., Goulding, D., et al. (2012). Bifidobacterial surface-exopolysaccharide facilitates commensal-host interaction through immune modulation and pathogen protection. Proc Natl Acad Sci U S A 109(6), 2108-2113. doi: 10.1073/pnas.1115621109.
Ferrario, C., Milani, C., Mancabelli, L., Lugli, G.A., Duranti, S., Mangifesta, M., et al. (2016). Modulation of the eps-ome transcription of bifidobacteria through simulation of human intestinal environment. FEMS Microbiol Ecol 92(4), fiw056. doi: 10.1093/femsec/fiw056.
Frick, et al., Identification of commensal bacterial strains that modulate Yersinia enterocolitica and Dextran sodium sulfate-induced inflammatory responses: implications for the development of probiotics. Infection and immunity, Jul. 2007;75(7):3490-3497.
GB1612190.7 International Search Report dated Apr. 12, 2017.
GenBank Accession No. NR 044054.1 (Feb. 3, 2015) Blautia wexlerae strain SSM 19850 16S ribsomal RNA gene, partial sequence.
GenBank Accession No. NR_117867.1 (Feb. 3, 2015) Blautia stercoris strain GAM6-1 16S ribsomal RNA gene, partial sequence.
Genbank NCBI Reference Sequence: NR-044054.1, Blautia wexlerae strain DSM 19850 16S ribosomal RNA gene, partial sequence.
Genbank NCBI Reference Sequence: NR_117867.1, Blautia stercoris strain GAMC6-1 16S ribosomal RNA gene, partial sequence.
Genbank NCBI Reference Sequence: NR_026314, Blautia hydrongentrophica strain S5a36 16S ribosomal RNA gene, partial sequence.
Gonzalez-Rodriguez, I., Sanchez, B., Ruiz, L., Turroni, F., Ventura, M., Ruas-Madiedo, P., et al. (2012). Role of extracellular transaldolase from Bifidobacterium bifidum in mucin adhesion and aggregation. Appl Environ Microbiol 78(11), 3992-3998. doi: 10.1128/AEM.08024-11.
Gopal, P.K., Sullivan, P.A., Smart, J.B. Utilization of galacto-oligosaccharides as selective substrates for growth by lactic acid bacteria including Bifidobacterium lactis DR10 and Lactobacillus rhamnosus DR20 (200 1 ). International Dairy Journal, 11 (1-2), pp. 19-25.
Gousia, P., et al., Antimicrobial resistance of major foodbome pathogens from major meat products (20ll). Foodborne Pathogens and Disease, 8 (1), pp. 27-38.
Groeger, D., O'Mahony, L., Murphy, E.F., Bourke, J.F., Dinan, T.G., Kiely, B., et al. (2013). Bifidobacterium infantis 35624 modulates host inflammatory processes beyond the gut. Gut Microbes 4(4), 325-339. doi: 10.4161/gmic.25487.
GT Biologics obtains FDA orphan drug designation for paediatric crohn's drug, pharmaceutical-technology.com news, Oct. 8, 2013. Available at: http://www.pharmaceutical-technology.com/news/newsgt-biologics-obtains-fda-orphan-drug-designation-for-paediatric-crohns-drug?WT.mc_id=DN_News.
Hansen, et al., The role of mucosal immunity and host genetics in defining intestinal commensal bacteria. 2010. Curr. Opin. Gastroenterol., 26(6): 564-571.
Heberle, H., Meirelles, G.V., da Silva, F.R., Telles, G.P., and Minghim, R. (2015). InteractiVenn: a web-based tool for the analysis of sets through Venn diagrams. BMC Bioinformatics 16(1), 169. doi: 10.1186/s12859-015-0611-3.

Heuvelin, E., Lebreton, C., Grangette, C., Pot, B., Cerf-Bensussan, N., and Heyman, M. (2009). Mechanisms Involved in Alleviation of Intestinal Inflammation by Bifidobacterium Breve Soluble Factors. PLOS ONE 4(4), e5184. doi: 10.1371/journal.pone.0005184.
Hidalgo-Cantabrana, C., Lopez, P., Gueimonde, M., de Los Reyes-Gavilan, C.G., Suarez, A., Margolles, A., et al. (2012). Immune Modulation Capability of Exopolysaccharides Synthesised by Lactic Acid Bacteria and Bifidobacteria. Probiotics Antimicrob Proteins 4(4), 227-237. doi: 10.1007/s12602-012-9110-2.
Hidalgo-Cantabrana, C., Sanchez, B., Alvarez-Martin, P., Lopez, P., Martinez-Alvarez, N., Delley, M., et al. (2015). A single mutation in the gene responsible for the mucoid phenotype of *Bifidobacterium animalis* subsp. *lactis* confers surface and functional characteristics. Appl Environ Microbiol 81(23), 7960-7968. doi: 10.1128/AEM.02095-15.
Hidalgo-Cantabrana, C., Sanchez, B., Milani, C., Ventura, M., Margolles, A., and Ruas-Madiedo, P. (2014). Genomic overview and biological functions of exopolysaccharide biosynthesis in *Bifidobacterium* spp. Appl Environ Microbiol 80(1), 9-18. doi: 10.1128/AEM.02977-13.
Horn, et al., Synthesis of Oligonucleotides on Cellulose. Part II: Design and Synthetic Strategy to the Synthesis of 22 Oligodeoxynucleotides Coding for Gastric Inhibitory Polypeptide (GIP). 1980. Nuc Acids Res Symp Ser 225-232.
Horwell, et al., The 'peptoid' approach to the design of non-peptide, small molecule agonists and antagonists of neuropeptides. 1995. Trends Biotechnol. 13(4):132-134.
Hughes, K.R., Harnisch, L.C., Alcon-Giner, C., Mitra, S., Wright, C.J., Ketskemety, J., et al. (2017). Bifidobacterium breve reduces apoptotic epithelial cell shedding in an exopolysaccharide and MyD88-dependent manner. Open Biol 7(1). doi: 10.1098/rsob.160155.
Hytönen, J., Haataja, S., and Finne, J. (2003). *Streptococcus pyogenes* Glycoprotein-Binding Strepadhesin Activity Is Mediated by a Surface-Associated Carbohydrate-Degrading Enzyme, Pullulanase. Infection and Immunity 71(2), 784-793.
Hytonen, J., Haataja, S., and Finne, J. (2006). Use of flow cytometry for the adhesion analysis of *Streptococcus pyogenes* mutant strains to epithelial cells: investigation of the possible role of surface pullulanase and cysteine protease, and the transcriptional regulator Rgg. BMC Microbiol 6, 18. doi: 10.1186/1471-2180-6-18.
International Preliminary Report dated Mar. 1, 2017 for International Application No. PCT/GB2015/054113.
International Preliminary Report on Patentability for International Application No. PCT/GB2012/051686 dated Jan. 14, 2014.
International Search Report dated Feb. 10, 2016 for International Application No. PCT/GB2015/054113.
International Search Report dated Mar. 7, 2016 for International Application No. PCT/GB2015/054112.
International Search report dated Mar. 15, 2003 for International Application No. PCT/GB2002/05255.
International Search Report for International Application No. PCT/GB2012/051686 dated Jan. 31, 2013.
International search report with written opinion dated Jun. 8, 2017 for GB Application No. 1616016.
International search report with written opinion dated Sep. 29, 2017 for GB Application No. 1621123.
International search report with written opinion dated Oct. 16, 2017 for PCT/GB2017/052076.
Inturri, R., Molinaro, A., Di Lorenzo, F., Blandino, G., Tomasello, B., Hidalgo-Cantabrana, C., et al. (2017). Chemical and biological properties of the novel exopolysaccharide produced by a probiotic strain of Bifidobacterium longum. Carbohydr Polym 174, 1172-1180. doi: 10.1016/j.carbpol.2017.07.039.
Israel, E. et al., Supplementary Appendix, Severe and difficult-to-treat asthma in adults. N. Engl J Med 2017;p. 377:965-76. DOI: 10.1056/NEJMra1608969.
Israel, et al., Severe and difficult-to-treat asthma in adults, The New England Journal of Medicine, Sep. 2017; 377(10):965-976.
Issue Notification dated Feb. 20, 2019 for Co-Pending U.S. Appl. No. 15/631,945.
Ivanov, D., Emonet, C., Foata, F., Affolter, M., Delley, M., Fisseha, M., et al. (2006). A serpin from the gut bacterium Bifidobacterium

(56) References Cited

OTHER PUBLICATIONS longum inhibits eukaryotic elastase-like serine proteases. J Biol Chem 281(25), 17246-17252. doi: 10.1074/jbc.M601678200.
Jackson MS, Bird AR, McOrist AL. Comparison of two selective media for the detection and enumeration of Lactobacilli in human faeces (2002). J Microbial Methods. 51 (3), pp. 313-321.
Jenq, Robert R., Intestinal Bluatia is associated with reduced death from graft versus-host disease, Bio Blood Marro Transplant. Aug. 2015; 21(8): 1373-1383. doi:10.1016/j.bbmt.2015.04.016.
Jeon, S.G., Kayama, H., Ueda, Y., Takahashi, T., Asahara, T., Tsuji, H., et al. (2012). Probiotic Bifidobacterium breve induces IL-10-producing Tr1 cells in the colon. PLoS Pathog 8(5), e1002714. doi: 10.1371/journal.ppat.1002714.
Joblin K N., "Ruminal Acetogens and Their Potential to Lower Remnant Methane Emissions." Australian Journal of Agricultural Research. vol. 50. No. 8. 1999, pp. 1307-1313. XP001010439.
Keller et al. "DNA Probes", 1994. Stockton Press. New York. XP002158943 108660 pp. 594-596.
Kinoshita, H., Uchida, H., Kawai, Y., Kawasaki, T., Wakahara, N., Matsuo, H., et al. (2008). Cell surface Lactobacillus plantarum LA 318 glyceraldehyde-3-phosphate dehydrogenase (GAPDH) adheres to human colonic mucin. J Appl Microbiol 104(6), 1667-1674. doi: 10.1111/j.1365-2672.2007.03679.x.
Kishimoto, M., Nomoto, R., Mizuno, M., and Osawa, R. (2017). An in vitro investigation of immunomodulatory properties of Lactobacillus plantarum and L. delbrueckii cells and their extracellular polysaccharides. Bioscience of Microbiota, Food and Health 36(3), 101-110. doi: 10.12938/bmfh.17-001.
Kitahara et al., *Bacteroides plebeius* sp. nov. and *Bacteroides coprocola* sp. nov., isolated from human faeces, 2005; Int J Syst Ev Microbiol 55: 2143-47.
Kogyo, S. Lactic Acid Bacteria, Intestinal Flora ad Health II; Physiological effects of heat-treated lactococcus "EF-2001" and application to food. Mar. 30, 2001 vol. 44, No. 6, pp. 35-39.
Koh, Gar Yee et al., Parabacteroides distasonis attenuate toll-like receptor 4 signalling and Akt activation and blocks colon tumor formulation in high-fat-diet-fed azoxymethane-treated mice, International Journal of Cancer, pp. 1-30. Accepted Article, doi: 10.1002/ijc.31559.
Korhonen, J.M., Sclivagnotis, Y., Von Wright, A Characterization of dominant cultivable lactobacilli and their antibiotic resistance profiles from faecal samples of weaning piglets (2007). Journal of Applied Microbiology, 103 (6), pp. 2496-2503.
Kumolosasi, E., Salim, E., Jantan, I., and Ahmad, W. (2014). Kinetics of Intracellular, Extracellular and Production of Pro-Inflammatory Cytokines in Lipopolysaccharide-Stimulated Human Peripheral Blood Mononuclear Cells. Tropical Journal of Pharmaceutical Research 13(4), 536-543. doi: 10.4314/tjpr.v13i4.8.
Lahteinen, T., et al., A Pro biotic properties of Lactobacillus isolates originating from porcine intestine and feces (20 10) Anaerobe, 16 (3), pp. 293-300.
Law, J., Buist, G., Haandrikman, A., Kok, J., Venema, G., and Leenhouts, K. (1995). A system to generate chromosomal mutations in Lactococcus lactis which allows fast analysis of targeted genes. Journal of Bacteriology 177(24), 7011-7018.
Lebeer, S., Claes, I.J., Verhoeven, T.L., Vanderleyden, J., and De Keersmaecker, S.C. (2011). Exopolysaccharides of Lactobacillus rhamnosus GG form a protective shield against innate immune factors in the intestine. Microb Biotechnol 4(3), 368-374. doi: 10.1111/j.1751-7915.2010.00199.x.
Lebeer, S., Verhoeven, T.L., Francius, G., Schoofs, G., Lambrichts, I., Dufrene, Y., et al. (2009). Identification of a Gene Cluster for the Biosynthesis of a Long, Galactose-Rich Exopolysaccharide in Lactobacillus rhamnosus GG and Functional Analysis of the Priming Glycosyltransferase. Appl Environ Microbiol 75(11), 3554-3563. doi: 10.1128/AEM.02919-08.
Leser et al. 'Culture-independent analysis of gut bacteria: the pig gastrointestinal tract microbiota revisited'. Applied and Environmental Microbiology. 2002, vol. 68, No. 2, pp. 673-690.

Li, C.Y., Lin Hc Fau—Lai, C.-H., Lai Ch Fau—Lu, J.J.-Y., Lu Jj Fau—Wu, S.-F., Wu Sf Fau—Fang, S.-H., and Fang, S.H. (2011). Immunomodulatory effects of lactobacillus and Bifidobacterium on both murine and human mitogen-activated T cells. Int Arch Allergy Immunol 156(2), 128-136. doi: 10.1159/000322350.
Li, et al.,. Screening and Identification of Lactobacillus animalis strain and characteristics of its bacteriostatic protein, Weishengwuxue Tongbao 2009; 36(7): 1001-1007.
Liu, Y., et al., Human-derived probiotic Lactobacillus reuteri strains differentially reduce intestinal inflannuation (20 10). American Journal of Physiology-Gastrointestinal and Liver Physiology, 299 (5), pp. G1087-G1096.
Ljungh, A, Wadstrorn, T. Lactic acid bacteria as probiotics (2006). Current Issues in Intestinal Microbiology, 7 (2), pp. 73-90.
Lopez, P., Gonzalez-Rodriguez, I., Sanchez, B., Ruas-Madiedo, P., Suarez, A., Margolles, A., et al. (2012). Interaction of Bifidobacterium bifidum LMG13195 with HT29 cells influences regulatory-T-cell-associated chemokine receptor expression. Appl Environ Microbiol 78(8), 2850-2857. doi: 10.1128/AEM.07581-11.
Lopez-Boado, Y. S. et al., Bacterial Exposure Induces and Activates Matrilysin in Mucosal Epithelial Cells. J Cell Biol148, 1305-1315 (2000).
Lozupone. Diversity, stability and resilience of the human gut microbiota. 2012. Nature. Sep. 13, 2012; 489 (7415): 220-230.
López, P., González-Rodríguez, I., Gueimonde, M., Margolles, A., and Suárez, A. (2011). Immune Response to Bifidobacterium bifidum Strains Support Treg/Th17 Plasticity. PLOS ONE 6(9), e24776. doi: 10.1371/journal.pone.0024776.
López, P., Gueimonde, M., Margolles, A., and Suárez, A. (2010). Distinct Bifidobacterium strains drive different immune responses in vitro. International Journal of Food Microbiology 138(1), 157-165. doi: https://doi.org/10.1016/j.ijfoodmicro.2009.12.023.
Álvarez-Martín, P., O'Connell-Motherway, M., van Sinderen, D., and Mayo, B. (2007). Functional analysis of the pBC1 replicon from Bifidobacterium catenulatum L48. Applied Microbiology and Biotechnology 76(6), 1395. doi: 10.1007/s00253-007-1115-5.
Martin R. et al., Isolation of lactobacilli from sow milk and evaluation of their probiotic potential. J of dairy research 76(4)418-425. Nov. 2009.
Matthes, et al., Simultaneous rapid chemical synthesis of over one hundred oligonucleotides on a microscale. Apr. 1984. EMBO Journal, 3(4): p. 801-805.
McCarville, J.L., Dong, J., Caminero, A., Bermudez-Brito, M., Jury, J., Murray, J.A., et al. (2017). A Commensal Bifidobacterium longum Strain Prevents Gluten-Related Immunopathology in Mice through Expression of a Serine Protease Inhibitor. Applied and Environmental Microbiology 83(19), e01323-01317. doi: 10.1128/AEM.01323-17.
McClymont, S.A., Putnam Al Fau—Lee, M.R., Lee Mr Fau—Esensten, J.H., Esensten Jh Fau—Liu, W., Liu W Fau—Hulme, M.A., Hulme Ma Fau—Hoffmuller, U., et al. (2011). Plasticity of human regulatory T cells in healthy subjects and patients with type 1 diabetes. Journal of Immunology 186(7), 3918-3926. doi: 10.4049/jimmunol.1003099.
Menard, S., Laharie D Fau—Asensio, C., Asensio C Fau—Vidal-Martinez, T., Vidal-Martinez T Fau—Candalh, C., Candalh C Fau—Rullier, A., Rullier A Fau—Zerbib, F., et al. (2005). Bifidobacterium breve and *Streptococcus thermophilus* secretion products enhance T helper 1 immune response and intestinal barrier in mice. Experimental Biology and Medicine (Maywood) 230(10), 749-756.
Meyza, et al. The BTBR mouse model of idiopathic autism—Current view on mechanisms. 2017. Neurosci Biobehav Rev.;76(Pt A):99-110.
Milani, C., Mangifesta, M., Mancabelli, L., Lugli, G.A., Mancino, W., Viappiani, A., et al. (2017). The Sortase-Dependent Fimbriome of the Genus Bifidobacterium: Extracellular Structures with Potential to Modulate Microbe-Host Dialogue. Appl Environ Microbiol 83(19). doi: 10.1128/AEM.01295-17.
Miraglia Del Giudice, M., Indolfi, C., Capasso, M., Maiello, N., Decimo, F., and Ciprandi, G. (2017). Bifidobacterium mixture (B longum BB536, B infantis M-63, B breve M-16V) treatment in

(56) References Cited

OTHER PUBLICATIONS children with seasonal allergic rhinitis and intermittent asthma. Italian Journal of Pediatrics 43(1), 25. doi: 10.1186/s13052-017-0340-5.
Molecular Biology Techniques, 1st edition. An intensive laboratory course. 1998.
Mortaz, E. et, al., Anti-Inflammatory Effects of Lactobacillus Rahmosus and Bifidobacterium Breve on Cigarette Smoke Activated Human Mcrophiages, PLoS ONE, Apr. 21, 20i15, 10(8):e0136455.DOI:10.1371, Journal.pone.0136455.
Mulder et al. 'Environmentally-acquired bacteria influence microbial diversity and natural innate immune responses at gut surfaces'. BMC Biology. 2009, vol. 7, No. 1, pp. 79.
Murofushi, Y., Villena, J., Morie, K., Kanmani, P., Tohno, M., Shimazu, T., et al. (2015). The toll-like receptor family protein RP105/MD1 complex is involved in the immunoregulatory effect of exopolysaccharides from Lactobacillus plantarum N14. Mol Immunol 64(1), 63-75. doi: 10.1016/j.molimm.2014.10.027.
Naughton PJ; Grant G. (2005) Modelling of salmonellosis In: Microbial Ecology of the Growing Animal Holzapfel WH, Naughton PJ. (Eds). London, Elsevier. pp. 235-257.
Neeser, J.R., et al., Lactobacillus johnsonii Lal shares carbohydrate-binding specificities with several enteropathogenic bacteria (2000). Glycobiology, 10 (11), pp. 1193-1199.
Neish, A. S. et al., Prokaryotic Regulation of Epithelial Responses by Inhibition of IκB-α Ubiquitination. Science 289, 1560 (2000).
Nemeth et al. 'Inhibition of *Salmonella*-induced IL-8 synthesis and expression of Hsp70 in enterocyte-like Caco-2 cells after exposure to non-starter lactobacilli'. International Journal of Food Microbiology. 2006, vol. 112, No. 3, pp. 266-274.
Nicolau, D.P. Current challenges in the management of the infected patient (2011). Current Opinion in Infectious Diseases, 24 (Suppl1), pp. Sl-S10.
Notice of Allowance dated Mar. 30, 2011 for U.S. Appl. No. 10/285,224.
Notice of Allowance dated Apr. 25, 2016 for U.S. Appl. No. 14/232,475.
Notice of Allowance dated Aug. 23, 2016 for U.S. Appl. No. 14/232,475.
Notice of Publication dated Dec. 27, 2018 for U.S. Appl. No. 16/022,256.
O'Connell Motherway, M., Kinsella, M., Fitzgerald, G.F., and Sinderen, D. (2013). Transcriptional and functional characterization of genetic elements involved in galacto-oligosaccharide utilization by Bifidobacterium breve UCC2003. Microbial biotechnology 6(1), 67-79. doi: 10.1111/1751-7915.12011.
O'Connell Motherway, M., O'Driscoll, J., Fitzgerald Gerald, F., and Van Sinderen, D. (2009). Overcoming the restriction barrier to plasmid transformation and targeted mutagenesis in Bifidobacterium breve UCC2003. Microbial Biotechnology 2(3), 321-332. doi: 10.1111/j.1751-7915.2008.00071.x.
O'Connell Motherway, M., Zomer, A., Leahy, S.C., Reunanen, J., Bottacini, F., Claesson, M.J., et al. (2011). Functional genome analysis of Bifidobacterium breve UCC2003 reveals type IVb tight adherence (Tad) pili as an essential and conserved host-colonization factor. Proc Natl Acad Sci U S A 108(27), 11217-11222. doi: 10.1073/pnas.1105380108.
Odamaki, Toshitaka et al., "Age-related changes in gut microbiota composition from newborn to centenarian: a cross-sectional study," BMC Microbiology (2016) 16:90, pp. 1-12, DOI 10.1186/S12866-016-0708-5.
Office Action dated Mar. 19, 2019 for U.S. Appl. No. 16/031,024.
Ohashi, Y., Ushida, K. Health-beneficial effects ofprobiotics: Its mode of action (2009). Animal Science Journal, 80 (4), pp. 361-371.
Olivares, M., Castillejo, G., Varea, V., and Sanz, Y. (2014). Double-blind, randomised, placebo-controlled intervention trial to evaluate the effects of Bifidobacterium longum CECT 7347 in children with newly diagnosed coeliac disease. British Journal of Nutrition 112(1), 30-40. doi: 10.1017/S0007114514000609.

O'Sullivan et al., "Bacterial Supplementation in the Irritable Bowel Syndrome. A Randomised Double-Blind Placebo-Controlled Crossover Study", Digest Liver Dis. 2000. pp. 294-301.
Overbeek, R., Begley, T., Butler, R.M., Choudhuri, J.V., Chuang, H.-Y., Cohoon, M., et al. (2005). The Subsystems Approach to Genome Annotation and its Use in the Project to Annotate 1000 Genomes. Nucleic Acids Research 33(17), 5691-5702. doi: 10.1093/nar/gki866.
Pang, et al., Crystal structure of human pirin: an iron-binding nuclear protein and transcription cofactor. Journal of Biological Chemistry, 279(2); Jan. 9, 2004:1491-1498.
Paustian, C., Taylor, P., Johnson, T., Xu, M., Ramirez, N., Rosenthal, K.S., et al. (2013). Extracellular ATP and Toll-like receptor 2 agonists trigger in human monocytes an activation program that favors T helper 17. PLoS One 8(1), e54804. doi: 10.1371/journal.pone.0054804.
Coakley M et al: Intestinal bifidobacteria that produce trans-9, trans-11 conjugated linoleicacid: A fatty acid with antiproliferative activity against human colon SW480and HT-29 cancer cells, Nutrition and Cancer, Taylor & Francis Group, US vol. 56, No. 1, Jan. 1, 2006 (Jan. 1, 2006), pp. 95-102, XP008087265, ISSN: 0163-5581, DOI:10.1207/515327914NC5601 13 cf. abstract, p. 101, last para. of the right-hand col.
PCT/EP2017/025038 International Preliminary Report on Patentability dated Jun. 6, 2018, 8 Pages.
PCT/EP2017/025038 International Search Report and Written Report dated Jun. 12, 2017.
PCT/EP2017/025038 Written Opinion of the International Preliminary Examining Authority dated Jan. 25, 2018.
PCT/GB2017/052076 Written Opinion of the International Preliminary Examining Authority dated Jun. 21, 2018, 11 Pages.
PCT/GB2017/052077 International Search Report dated Oct. 16, 2017.
PCT/GB2017/052077 Written Opinion dated Oct. 16, 2017.
PCT/GB2017/052077 Written Opinion of the International Preliminary Examining Authority dated Jun. 21, 2018, 10 Pages.
Database WPI, Week 201801, Thomson Scientific, London, GB; AN 2017-834299, XP002787097, & WO 2017/209156 AI (Morinaga Milk Ind Co. Ltd) Dec. 7, 2017 (Dec. 7, 2017) * abstract * of WO2017/2019156, Kobayashi, Youdai et al.
Pearson, WR. An introduction to sequence similarity ("Homology") searching. Current protocols in bioinformatics/editoral board, Andreas D Baxevanis. [et al]. 2013; 0 3:10.1002/0471250953.bi0301s42. doi:10.1002/0471250953.bi0301s42.
Petersen et al. Intestinal colonization with phylogenetic group B2 *Escherichia coli* related to inflammatory bowel disease: a systematic review and meta-analysis. 2015. Scand J Gastroenterol. ;50(10):1199-207.
Petsuriyawong et al. 'Screening of probiotic lactic acid bacteria from piglet feces'. Nature Science. 2011, vol. 45, pp. 245-253.
Hoarau, Cyrille et al., Supernatant from Bifidobacterium Differentially Modulates Transduction Signaling Pathways for Biological Functions of Human Dendritic Cells, PLOS ONE, Public Library of Science, US, vol. 3, No. 7, Jul. 1, 2008 (Jul. 1, 2008), pp. e2753-1, XP009139666,ISSN: 1932-6203 *cf. abstract and conclusion, furthermore discussion part at p. 3, col. at the right side*.
Pinto-Sánchez, M.I., Smecuol, E.C., Temprano, M.P., Sugai, E., Gonzalez, A., Moreno, M.L., et al. (2017). Bifidobacterium infantis NLS Super Strain Reduces the Expression of α-Defensin-5, a Marker of Innate Immunity, in the Mucosa of Active Celiac Disease Patients. Journal of Clinical Gastroenterology 51(9), 814-817. doi: 10.1097/mcg.0000000000000687.
Database WPI,Week 201801, Thomson Scientific, London, GB; AN 2017-834299, XP002787097,& WO 2017/209156 Al (Morinaga Milk Ind Co Ltd) Dec. 7, 2017 (Dec. 7, 2017) * abstract *.
Hoarau et al: "TLR2 Activation by Supernatant From Bifidobacterium Breve Modulates Maturation and Survival of Human DCs Via Differential Effects on PI3Kinase, p38 and ERK Pathways",Journal of Allergy and Clinical Immuno, Elsevier, Amsterdam, NL, vol. 119, No. 1, Jan. 1, 2007 (Jan. 1, 2007), p. S258, XP005756921, ISSN: 0091-6749, DOI: 10.1016/J.JACI.2006.12.377 *cf. abs.No. 1008 at p. S258*.

(56) References Cited

OTHER PUBLICATIONS

Liu, Chang-jian et al., Antioxidant and Cholesterol-Reducing Properties of Enterococcus gallinarum m661, Bioengineering (Food Science), vol. 34, No. 7, Dec. 31, 2013, pp. 157-161.

Matsuda F et al: Evaluation of a probiotics,BBG-01, for enhancement of immunogenicity of an oral inactivated cholera vaccine and safety: a randomized, double-blind, placebo-controlled trial in Bangladeshi children under 5 years of age,Vaccine, Elsevier, Amsterdam, NL, vol. 29, No. 10, Dec. 26, 2010 (Dec. 26, 2010), pp. 1855-1858, XP028147184, ISSN: 0264-410X, DOI: 10.1016/J.VACCINE.2010.12.133 [retrieved on Jan. 7, 2011] *cf. abstract*.

Scuotto, Angelo et al., In silico mining and characterization of bifidobacterial lipoprotein with CHHP domain secreted in an aggregated form, International J. of Biol. Macromolecutes 82(2016), 653-662.

Rajilic-Stojanovic, et al. The first 1000 cultures species of the human gastrointestinal micriobiota. FEMS MIcriobiol Rev, vol. 38, 2014. pp. 996-1047.

Reddy, K.B.P.K., et al., Role of cryoprotectants on the viability and functional properties of pro biotic lactic acid bacteria during freeze drying (2009). Food Biotechnology, 23 (3), pp. 243-265.

Remington. Remington: The science and practice of pharmacy. 20th Edition. Gennaro, Eds. Lippincott Williams & Wilkins, 2003.

Reuter, G. (2001). The Lactobacillus and Bifidobacterium microflora of the human intestine: composition and succession. Current Issues in Intestinal Microbiology 2(2), 43-53.

Rhee, Young-Kyung et al.., Antihumor Activity of *Bifidobacterium* Spp. isolated from a healthy Korean, Arch Pharm Res vol. 23, No. t, 482-487 2000.

Riquelme. Will 4D Pharma be UK's next Microbiome leader? Feb. 2, 2015, LABIOTECH.eu [online].

Robertson, J.M.C., et al., Lack of flagella disadvantages *Salmonella enterica* serovar Enteritidis during the early stages of infection in the rat (2003). Journal of Medical Microbiology, 52 (1), pp. 91-99.

Rong, Y., Dong, Z., Hong, Z., Jin, Y., Zhang, W., Zhang, B., et al. (2017). Reactivity toward Bifidobacterium longum and Enterococcus hirae demonstrate robust CD8(+) T cell response and better prognosis in HBV-related hepatocellular carcinoma. Experimental Cell Research 358(2), 352-359. doi: 10.1016/j.yexcr.2017.07.009.

Ruiz, L., Delgado, S., Ruas-Madiedo, P., Margolles, A., and Sanchez, B. (2016). Proteinaceous Molecules Mediating Bifidobacterium-Host Interactions. Front Microbiol 7, 1193. doi: 10.3389/fmicb.2016.01193.

Ruiz, P.A., Hoffmann, M., Szcesny, S., Blaut, M., and Haller, D. (2005). Innate mechanisms for Bifidobacterium lactis to activate transient pro-inflammatory host responses in intestinal epithelial cells after the colonization of germ-free rats. Immunology 115(4), 441-450. doi: 10.1111/j.1365-2567.2005.02176.x.

Saiki, et al., Primer-directed enzymatic amplification of DNA with a thermostable DNA polymerase. 1988. Science, 239. pp. 487-491.

Sakamato, et al., *Parabacteroides faecis* sp. nov., isolated from human faeces. International Journal of Systematic and Evolutionary Microbiology (2015), 65, 1342-1346.

Sakamoto, et al., *Parabacteroides gordonii* sp. nov., isolated from human blood cultures. International Journal of Systematic and Evolutionary Microbiology (2009), 59, 2843-2847.

Sakamoto, et al., *Parabacteroides johnsonii* sp. nov., isolated from human faeces. International Journal of Systematic and Evolutionary Microbiology (2007), 57, 293-296.

Sakamoto Mitsuo et al., Reclassfication of Baceroides distasonis, Bacteroides goldsteinii and Bacteroides merdae as *Parabacteroides distasonis* gen. nov., comb. nov., *Parabacteroides goldsteinii* comb. nov. and *Parabacteroides merdae* comb. nov., International Journal of Systematic and Evolutionary Microbiology (2006) 56, 15-99-1605. DOI 10.1099/ijs.0.0641920.

Schiavi, E., Gleinser, M., Molloy, E., Groeger, D., Frei, R., Ferstl, R., et al. (2016). The Surface-Associated Exopolysaccharide of Bifidobacterium longum 35624 Plays an Essential Role in Dampening Host Proinflammatory Responses and Repressing Local TH17 Responses. Appl Environ Microbiol 82(24), 7185-7196. doi: 10.1128/AEM.02238-16.

Schiavi, E., Plattner, S., Rodriguez-Perez, N., Barcik, W., Frei, R., Ferstl, R., et al. (2018). Exopolysaccharide from *Bifidobacterium longum* subsp. longum 35624 modulates murine allergic airway responses. Benef Microbes, 1-14. doi: 10.3920/BM2017.0180.

Schreiber, O, et al., Lactobacillus reuteri prevents colitis by reducing P-selectin-associated leukocyte- and plateletendothelial cell interactions (2009). American Journal of Physiology-Gastrointestinal and Liver Physiology, 296 (3), pp. G534-G542.

Severijnen, A. J. et al., Chronic Arthritis Induced in Rats by Cell Wall Fragments of *Eubacterium* Species from the Human Intestinal Flora. Infection and Immunity, 1990, vol. 58, No. 2, 523-528.

Simon, et al., Peptoids: A modular approach to drug discover, Oct. 1992. PNAS, 89(20):9367-9371.

Sivan, A., Corrales, L., Hubert, N., Williams, J.B., Aquino-Michaels, K., Earley, Z.M., et al. (2015). Commensal Bifidobacterium promotes antitumor immunity and facilitates anti-PD-L1 efficacy. Science 350(6264), 1084-1089. doi: 10.1126/science.aac4255.

Skolnick, et al. From genes to protein structure and function: novel applications of computational approaches in the genomic era. Trends Biotechnol. Jan. 2000;18(1):34-9. Review.

Smith, C.L., et al., Lactobacillus fermentum BRII and fmcto-oligosaccharide partially reduce jejunal inflammation in a model of intestinal mucositis in rats (2008). Nutrition and Cancer, 60 (6), pp. 757-767.

Song, Yuli et al., *Bacteroides goldsteinii* sp. nov. Isolated from Clinical Specimens of Human Intestinal Origin, J. Clinical Microbiology, Sep. 2005, p. 4522-4527. DOI:10.1128/JCM.43.9.4522-4527.2005.

Sonnenburg, et al., Genomic and Metabolic Studies of the Impact of Probiotics on a Model Gut Symbiont and Host. PLoS Biol 4(12): e413. https://doi.org/10.1371/journal.pbio.0040413.

U.S. Appl. No. 15/915,889 Notice of Allowance dated Jun. 4, 2018. Written Opinion for PCT/US2017/066709 (Published as WO2018/112365) owned by Evelo Biosciences, Inc.

Strasser, S. et al., Influence of lyophilization, fluidized bed drying, addition of protectants, and storage on the viability oflactic acid bacteria (2009). Journal of Applied Microbiology, 107 (1), pp. 167-177.

Strus et al. Distinct effects of Lactobacillus plantarum KL30B and *Escherichia coli* 3A1 on the induction and development of acute and chronic inflammation. 2015. Cent Eur J Immunol.40(4):420-30.

Supplement to: Israel, et al., Severe and difficult-to-treat asthma in adults. N Engl J Med 2017; 377:965-76.

Tahoun, A., Masutani, H., El-Sharkawy, H., Gillespie, T., Honda, R.P., Kuwata, K., et al. (2017). Capsular polysaccharide inhibits adhesion of Bifidobacterium longum 105-A to enterocyte-like Caco-2 cells and phagocytosis by macrophages. Gut Pathog 9, 27. doi: 10.1186/s13099-017-0177-x.

Tan, Hai-Qin et al., *Parabacteroides chartae* sp. nov., an obligately anaerobic species from wastewater of a paper mill, International Journal of systematic and Evolutionary Microbiology (2012), 62-2613-2617, DOI 10.1099/ijs.0.038000-0.

Tatusova et al., BLAST 2 Sequences, a new tool for comparing protein and nucleotidesequences, FEMS Microbiology Letters 174 (1999) 247-250.

Tatusova et al., Erratum to BLAST 2 Sequences, a new tool for comparing protein and nucleotide sequences, FEMS Microbiology Letters 177 (1999) 187-188.

Teng, L. J. et al., PCR Assay for Species-Specific Identification ofBacteroides thetaiotaomicron. J Clin Microbiol38, 1672-1675 (2000).

Terciz, Janos et al., Inflammation and Colon Cancer, Gastroenterology, 2010: 138: 2101-2114.

Tomas, M.S.J., et al., Stability of freeze-dried vaginal Lactobacillus strains in the presence of different lyoprotectors (2009). Canadian Journal of Microbiology, 55 (5), pp. 544-552.

Tomosada, Y., Villena, J., Murata, K., Chiba, E., Shimazu, T., Aso, H., et al. (2013). Immunoregulatory Effect of Bifidobacteria Strains

(56) References Cited

OTHER PUBLICATIONS in Porcine Intestinal Epithelial Cells through Modulation of Ubiquitin-Editing Enzyme A20 Expression. PLOS ONE 8(3), e59259. doi: 10.1371/journal.pone.0059259.

Turnbaugh et al. A core gut microbiome in obese and lean twins. Jan. 22, 2009. Nature, 457(7228): 480-484.

Turroni, F., Taverniti V Fau—Ruas-Madiedo, P., Ruas-Madiedo P. Fau—Duranti, S., Duranti S Fau—Guglielmetti, S., Guglielmetti S Fau—Lugli, G.A., Lugli Ga Fau—Gioiosa, L., et al. (2014). Bifidobacterium bifidum PRL2010 modulates the host innate immune response. Appl Environ Microbiol 80(1098-5336 (Electronic)), 730-740.

Tzortzis, G., et al., Modulation of anti-pathogenic activity in canine-derived *Lactobacillus* species by carbohydrate growth substrate (2004). Journal of Applied Microbiology, 96 (3), pp. 552-559.

Untergasser, A., Nijveen, H., Rao, X., Bisseling, T., Geurts, R., and Leunissen, J.A. (2007). Primer3Plus, an enhanced web interface to Primer3. Nucleic Acids Res 35(Web Server issue), W71-74. doi: 10.1093/nar/gkm306.

U.S. Appl. No. 15/359,144 Notice of Allowance dated Sep. 4, 2018.
U.S. Appl. No. 15/359,972 Notice of Allowance dated Aug. 8, 2018.
U.S. Appl. No. 15/592,178 Notice of Allowance dated Jul. 12, 2018.
U.S. Appl. No. 15/915,885 Notice of Allowance dated May 23, 2018.
U.S. Appl. No. 15/916,167 Notice of Allowance dated May 31, 2018.
U.S. Appl. No. 15/916,205 Notice of Allowance dated May 30, 2018.
U.S. Appl. No. 15/431,393 Office Action dated Jul. 30, 2018.

Van de Pol, M.A. et al., Sybiotics reduce allergen-induced T-helper 2 respond and improve peak expiatory flow in allergic asthmatics, Allergy 2011;66:39-47.

Van Nevel et al., "Conrol of Rumen Methanogenesis." Environmental Monitoring and Assessment. vol. 42, 1996, pp. 73097, XP000979267.

Verheijden, K.A.T. et al., The development of allergic inflammation in a murine house dust mite asthma is suppressed by symbiotic mixtures of non-digestible oligosaccharides and Bifidobacterium breve M-16V; Eur. J. Nut. (2016) 55: 1141-1151, DOI 10.1007, 500394-015-0928-8.

Wang, Chun-Sai-Er, et al., VSL#3 can prevent ulcerative colitis-associated carcinogenesis in mice, Oct. 7, 2018, vol. 24, Issue 37, pp. 4254-4262.

Wang et al. 16S rRNA gene-based analysis of fecal microbiota from preterm infants with and without necrotizing enterocolitis. 2009. ISME J. 3(8): 944-954.

Wang, Feng, Bifidobacterium can mitigate intestinal immunopathology in the context of CTLA-4 blockade, PNA, Jan. 2, 2018 vol. 115, No. 1, pp. 157-161.

Wang, G., Xia, Y., Cui, J., Gu, Z., Song, Y., Q., C.Y., et al. (2014). The Roles of Moonlighting Proteins in Bacteria. Current Issues in Molecular Biology 16, 15-22.

Wang, R.F., and Kushner, S.R. (1991). Construction of versatile low-copy-number vectors for cloning, sequencing and gene expression in *Escherichia coli*. Gene 100, 195-199. doi: https://doi.org/10.1016/0378-1119(91)90366-J.

Wang W., Lyophilization and development of solid protein pharmaceuticals. International J. Pharmaceutics 203: 1-60, 2000.

Wei, X., Yan, X., Chen, X., Yang, Z., Li, H., Zou, D., et al. (2014). Proteomic analysis of the interaction of Bifidobacterium longum NCC2705 with the intestine cells Caco-2 and identification of plasminogen receptors. J Proteomics 108, 89-98. doi: 10.1016/j.jprot.2014.04.038.

Welman, A.D., and Maddox, I.S. (2003). Exopolysaccharides from lactic acid bacteria: perspectives and challenges. Trends in Biotechnology 21(6), 269-274. doi: https://doi.org/10.1016/S0167-7799(03)00107-0.

Wendler, et al., Identification of a pirin, a novel highly conserved nuclear protein. J. Biol Chem. Mar. 28, 1997; 272(13):8482-9.

Wenzel, S.E., Asthma phenotypes: the evolution from clinical to molecular approaches, Nature medicine, May 2012; 18(5):716-725.

Westermann, C., Gleinser, M., Corr, S.C., and Riedel, C.U. (2016). A Critical Evaluation of Bifidobacterial Adhesion to the Host Tissue. Front Microbiol 7, 1220. doi: 10.3389/fmicb.2016.01220.

Williams, N.T. Probiotics (2010). American Journal of Health-System Pharmacy, 67 (6), pp. 449-458.

Written Opinion for PCT/US17/066709 (Published as WO2018112363) owned by Evelo Biosciences, Inc.

Xie et al. Short communication: Modulation of the small intestinal microbial community composition over short-term or long-term administration with Lactobacillus plantarum ZDY2013. 2016. Journal Dairy Sci. 99:6913-6921.

Xu, et al., A genomic view of the human-Bacteroides thetaiotaomicron symbiosis. Science. Mar. 28, 2003; 299(5615):2074-6.

Yang, Changa et al., Non-invasive imaging of toll-like receptor 5 expressing using 131 labelled mAb in the mice bearing H22 tumors, Oncol. Lett. 2014., 7(6).1919-1924., Published online Apr. 2014i12. DOI: 10.3892/ol.2014.2025.

Yao, W., et al., Cultivation-Independent Analysis of the Development of the *Lactobacillus* spp. Community in the Intestinal TractofNewbornPiglets (20ll)Agricultural Sciences in China, 10 (3), pp. 438-447.

Yq et al. Therapeutic Modulation of the Gut Microbiota in IBD—More Questions to Be Answered. (2016). J. Dig. Dis., Oct. 15, 1751-2980, 12422, Epub ahead of print.

Yu, Dah-Shyong et al., Bacille Calmette-Guerin can induce cellular apoptosis of urothelial cancer directly through toll-like receptor 7 activation, Kaohsiung Journal of Medical Sciences (2015) 31,391-397.

Yu, N.Y., Wagner, J.R., Laird, M.R., Melli, G., Rey, S., Lo, R., et al. (2010a). PSORTb 3.0: improved protein subcellular localization prediction with refined localization subcategories and predictive capabilities for all prokaryotes. Bioinformatics 26(13), 1608-1615. doi: 10.1093/bioinformatics/btq249.

Yun, J.H., et al., Isolation and characterization of potential pro biotic lactobacilli from pig feces (2009). Journal of Basic Microbiology, 49 (2), pp. 220-226.

Yurdusev, N. et al., Antagonistic Effect Exerted by Three Strictly Anaerobic Strains Against Various Strains of Clostridium Perfringens in Gnotobiotic Rodent Intestines. Can J Microbiol 33, 226-231 (1987).

Yurdusev, N. et al., InfectInunun 57,724-731 (1989).

Zheng, B., van Bergenhenegouwen, J., Overbeek, S., van de Kant, H.J., Garssen, J., Folkerts, G., et al. (2014). Bifidobacterium breve attenuates murine dextran sodium sulfate-induced colitis and increases regulatory T cell responses. PLoS One 9(5), e95441. doi: 10.1371/journal.pone.0095441.

Zheng, Bin et al., Bifodobacterium breve Attenuates Murine Dexran Doium Sulfate-Induced Colitis and Increases Regulatory T Cell Responses, PLOS ONE, vol. 9, Isue 5, e95441, May 2014.

Daniel Garrido et al., "Utilization of galactooligosaccharides by *Bifidobacterium longum* subsp.*infantis* isolates", Food Microbiology, 33 (2013) 262-270.

Dheeraj Mohania et al., "Modulation of expression of Programmed Death-1 by administration of probiotic Dahi in DMH-induced colorectal carcinogenesis in rats", ACTA BIOMED 2013; 84: 102-109.

Dong-Hyun Kim and Young-Ho Jin, "Intestinal Bacterial B-Glucuronidase Activity of Patients with Colon Cancer", Arch Pharm Res vol. 24, No. 6, 564-567, 2001.

Federico E. Rey et al., "Dissecting the in Vivo Metabolic Potential of Two Human Gut Acetogens", The Journal of Biological Chemistry, vol. 285, No. 29, pp. 22082-22090, Jul. 16, 2010.

Jagveer Singh et al., "Bifidobacterium longum, a lactic acid-producing intestinal bacterium inhibits colon cancer and modulates the intermediate biomarkers of colon carcinogenesis", Carcinogenesis vol. 18 No. 4 pp. 833-841, 1997.

Kari Shoaf et al., "Prebiotic Galactooligosaccharides Reduce Adherence of Enteropathogenic *Escherichia coli* to Tissue Culture Cells", Infection and Immunity, Dec. 2006, vol. 74. No. 12, p. 6920-6928.

Laetitia Rodes et al., "Microencapsulated *Bifidobacterium longum* subsp. infantis ATCC 15697 Favorably Modulates Gut Microbiota

(56) References Cited

OTHER PUBLICATIONS and Reduces Circulating Endotoxins in F344 Rats", BioMed Research International, vol. 2014, Article ID 602832, 11 pages.

Laureen Crouzet et al., "The altered gut microbiota of IBS patients plays a key role in visceral hypersensitivity: specific role of sulphate-reducing bacteria", INRA Symposium, 2012.

Mincheol Kim et al., "Towards a taxonomic coherence between average nucleotide identity and 16S rRNA gene sequence similarity for species demarcation of prokaryotes", International Journal of Systematic and Evolutionary Microbiology (2014), 64, 346-351.

Odile Menard et al, "Gnotobiotic Mouse Immune Response Induced by *Bifidobacterium* sp. Strains Isolated from Infants", Applied and Environmental Microbiology, Feb. 2008, p. 660-666.

Parfenov A.I., "Pain syndrome in the practice of a gastroenterologist", "Breast Cancer" №0 from Jan. 25, 2008, 5 pages, https://www.rmj.ru/articles/bolevoy_sindrom/Bolevoy_sindrom_v_praktike_gastroenterologa.

Choji Kaneuchi et al., "Clostridium coccoides, a New Species from the Feces of Mice", International Journal of Systematic Bacteriology, vol. 26, No. 4, Oct. 1976, p. 482-486.

Devillard, E. et al., Metabolism of Linoleic Acid by Human Gut Bacteria: Different Routes for Biosynthesis of Conjugated Linoleic Acid, Journal O. Bacteriology, 2007, vol. 189, No. 4, p. 2544-2570.

Pedro Berraondo et al., "Cytokines in clinical cancer immunotherapy", British Journal of Cancer, 2019, 120:6-15.

Ping Dong et al., "The role of intestinal bifidobacteria on immune system development in young rats", Early Human Development 86 (2010) 51-58.

NCBI Reference Sequence: NR_026314.1, Blautia hydrogenotrophica strain S5a36 16S ribosomal RNA gene, partial sequence (Feb. 3, 2015), 3 pages.

Sudha B. Singh and Henry C. Lin, "Hydrogen Sulfide in Physiology and Diseases of the Digestive Tract", Microorganisms 2015, 3, 866-889; doi:10.3390/microorganisms3040866.

Suzanne L. Topalian et al., "Survival, Durable Tumor Remission, and Long-Term Safety in Patients With Advanced Melanoma Receiving Nivolumab", Journal of Clinical Oncology, vol. 32, No. 10, Apr. 1, 2014, pp. 1-12.

Takashi Nakamura et al., "Evaluation of the Effects of Dietary Organic Germanium, Ge-132, and Raffinose Supplementation on Caecal Flora in Rats", Bioscience of Microbiota, Food and Health vol. 31 (2), 37-45, 2012.

U.S. Appl. No. 15/700,007 Non-Final Office Action dated Jun. 10, 2019.

U.S. Appl. No. 15/704,245 Non-Final Office Action dated Jul. 3, 2019.

U.S. Appl. No. 16/022,577 Non-Final Office Action dated Jul. 9, 2019.

Viaud, Sophie et al. "The intestinal microbiota modulates the anticancer immune effects of cyclophosphamide." Science (New York, N.Y.) vol. 342,6161 (2013): 971-6. doi:10.1126/science.1240537.

Yoshinori Kohwi et al., "Antitumor Effect of Bifidobacterium Infant's in Mice", Gann, 69, 613-618; Oct. 1978.

\* cited by examiner

Total macrophages.

Total neutrophils.

Neutrophils %

Total lymphocytes.

Lymphocytes %.

Macrophages %.

Neutrophils %.

Lymphocytes %

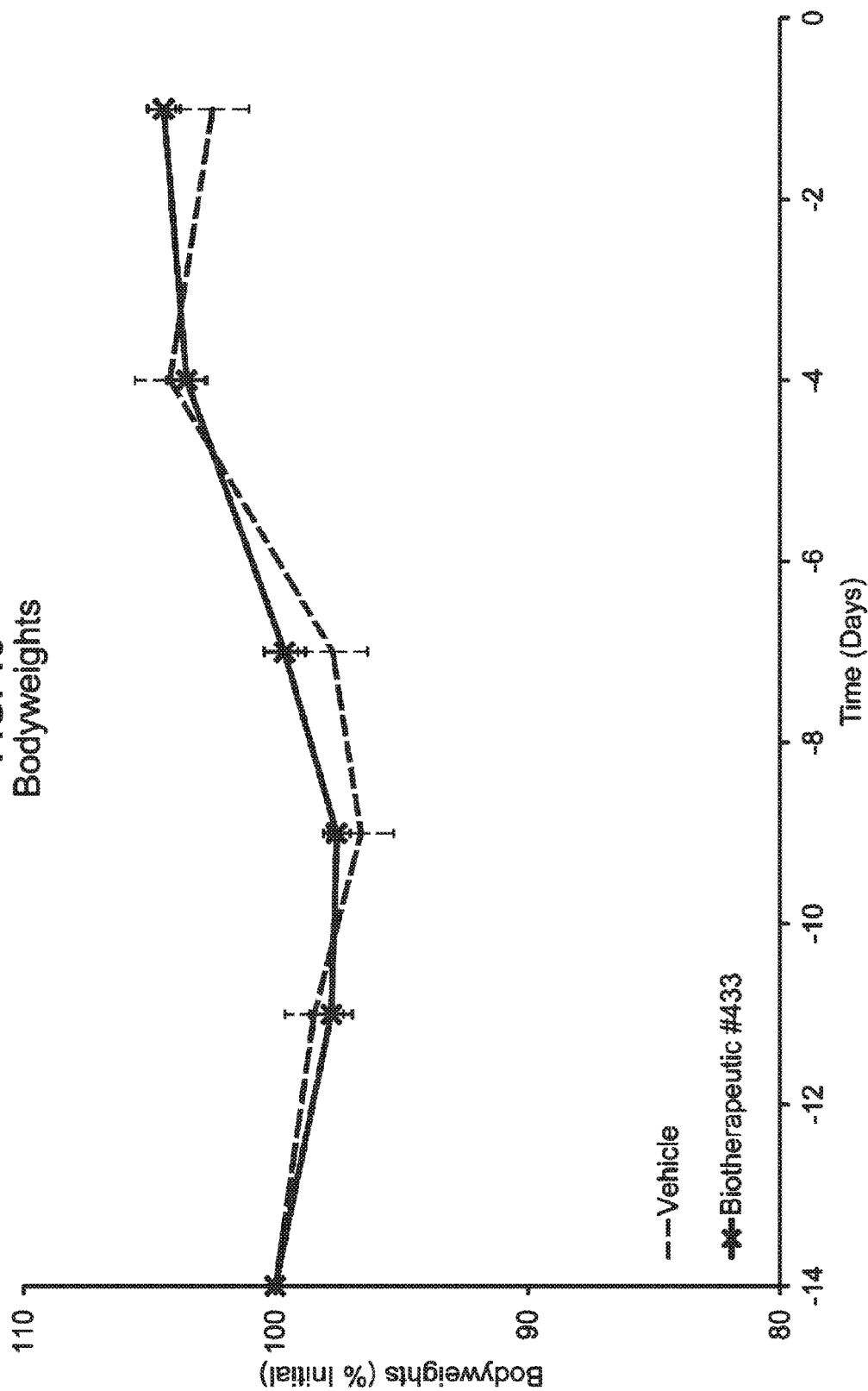

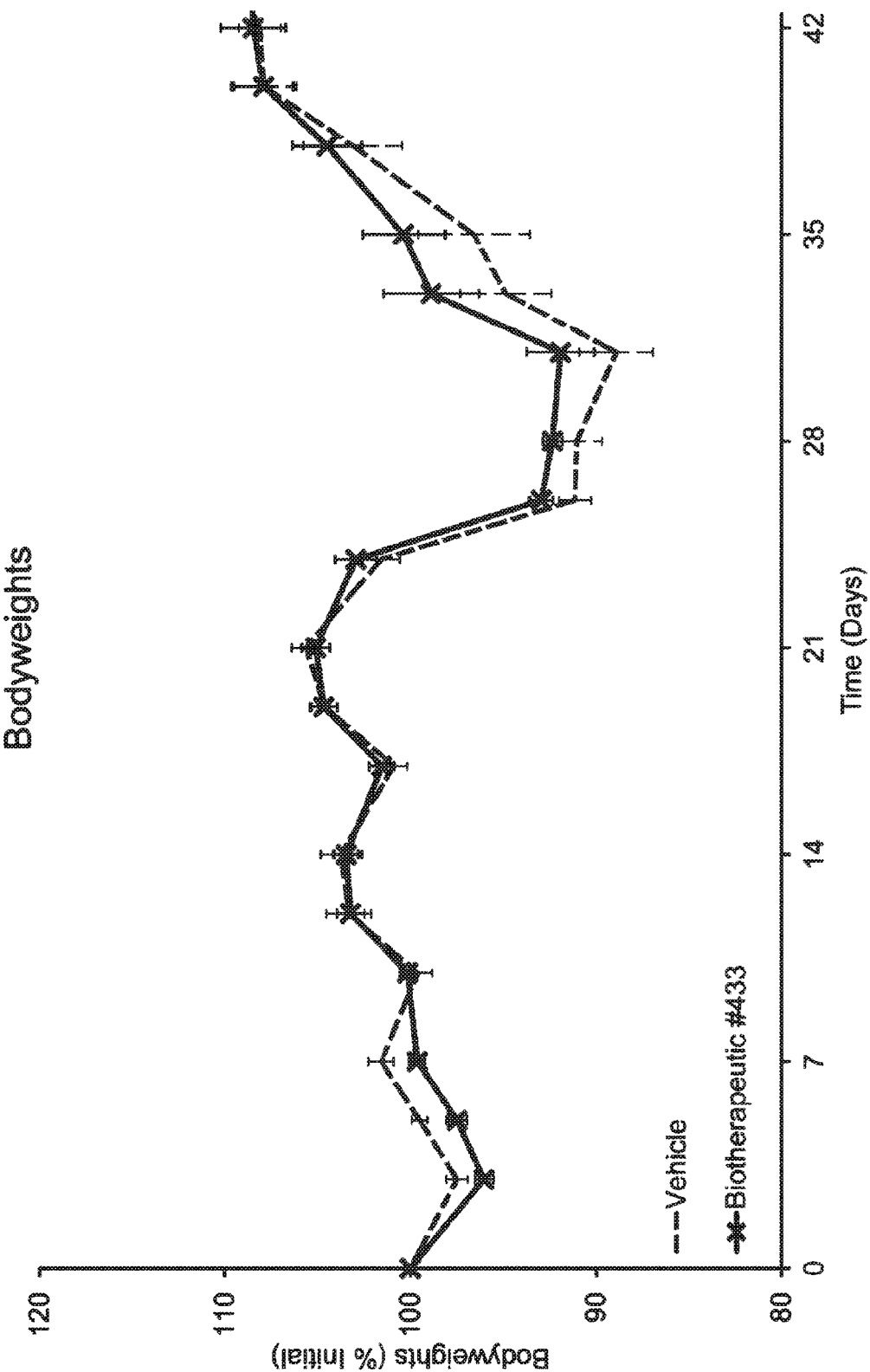

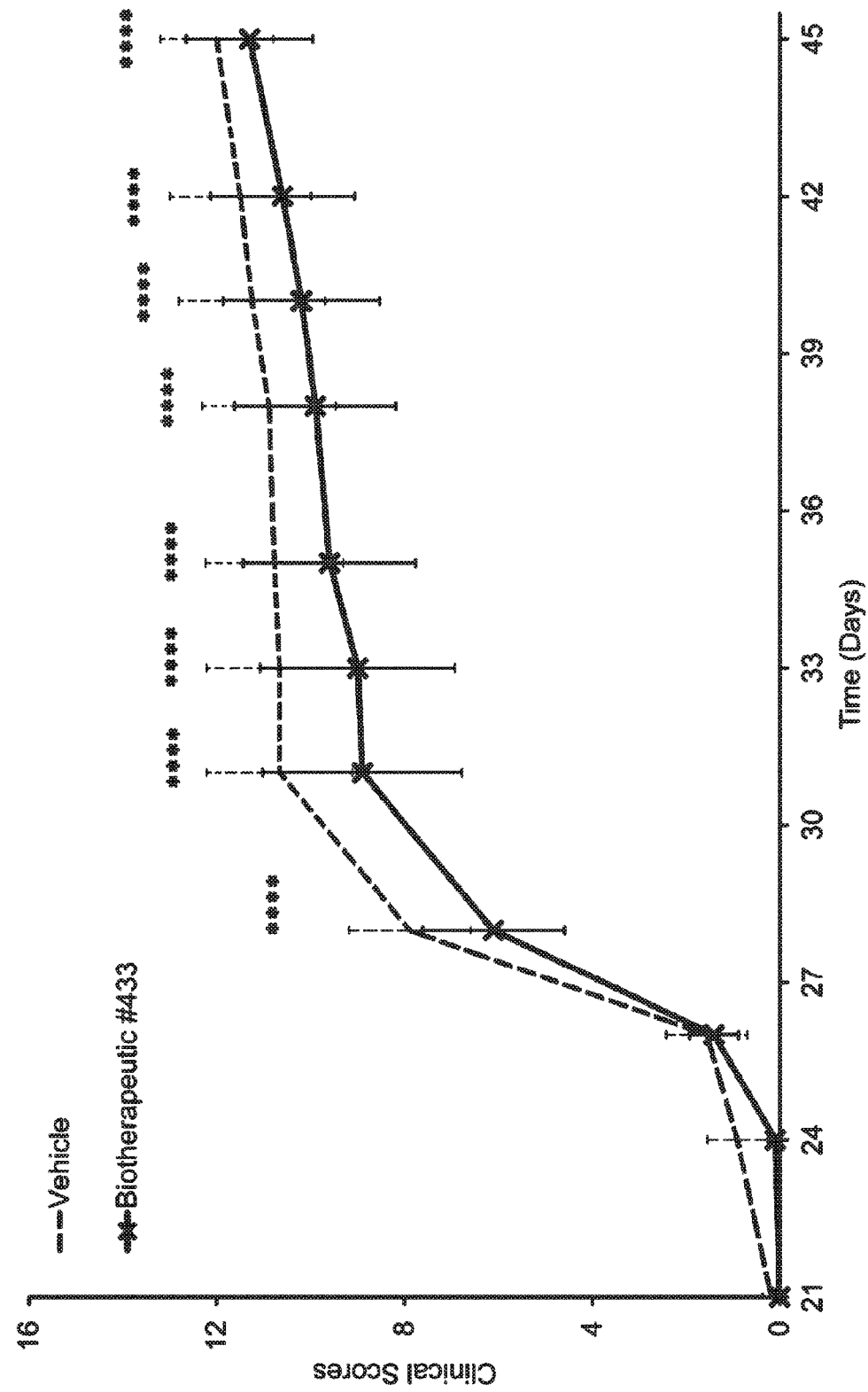

FIG. 31 Histological Analysis – Mean Peribronchiolar Infiltration Score

FIG. 33 Histological Analysis – Mean Inflammatory Score (Average of both Peribronchiolar and Perivascular Infiltration Score)

IFNg level in lung tissue

IL-17A level in lung tissue

KC level in lung tissue

FIG. 47 HDM specific IgG2a in Serum

FIG. 49 HDM specific IgG2a in BALF

FIG. 50 Histological Analysis – Mean Peribronchiolar Infiltration Score

FIG. 52 Histological Analysis - Mean Inflammatory Score (Average of both Peribronchiolar and Perivascular Infiltration Score)

IL-1a level in lung tissue

IL-17F level in lung tissue

IL-1b level in lung tissue

RANTES level in lung tissue

KC level in lung tissue

MIP-1a level in lung tissue

FIG. 64
Visual Template for Histopathology Scoring
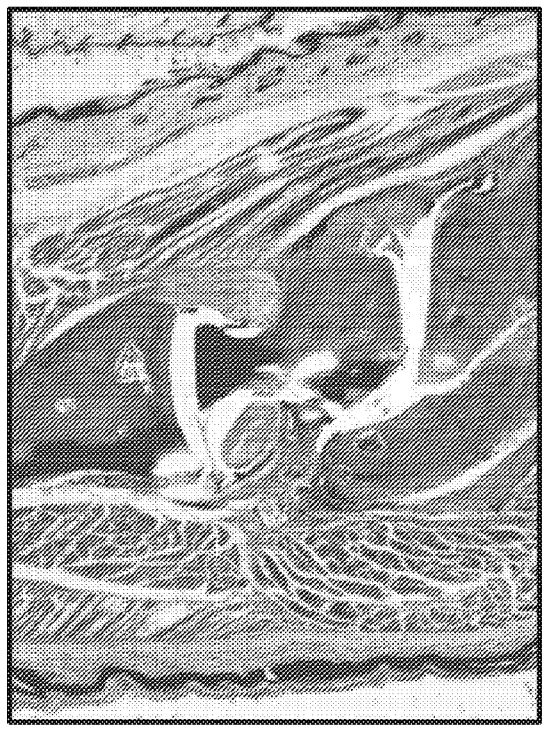
Grade 1
Grade 0

FIG. 64(contd.)
Grade 7
Grade 4

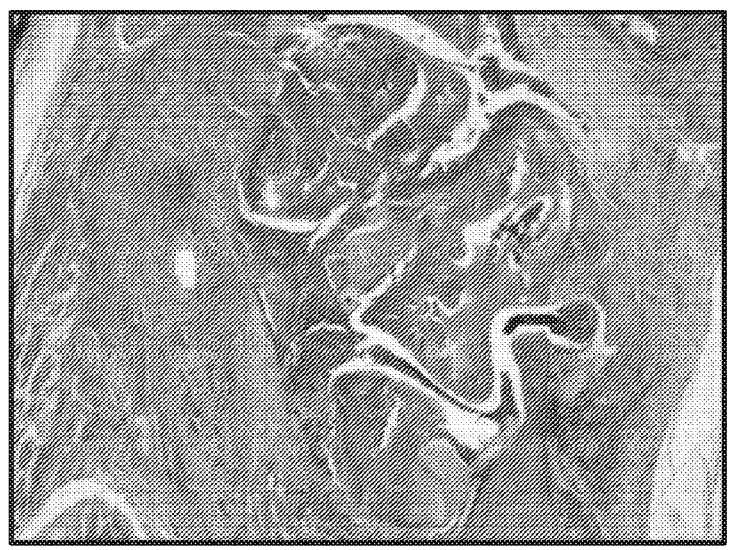
Grade 9
FIG. 64(contd.)

Histopathology: Inflammation Scores

Histopathology: Cartilage Scores

Histopathology: Total Scores

Histopathology: Bone Scores

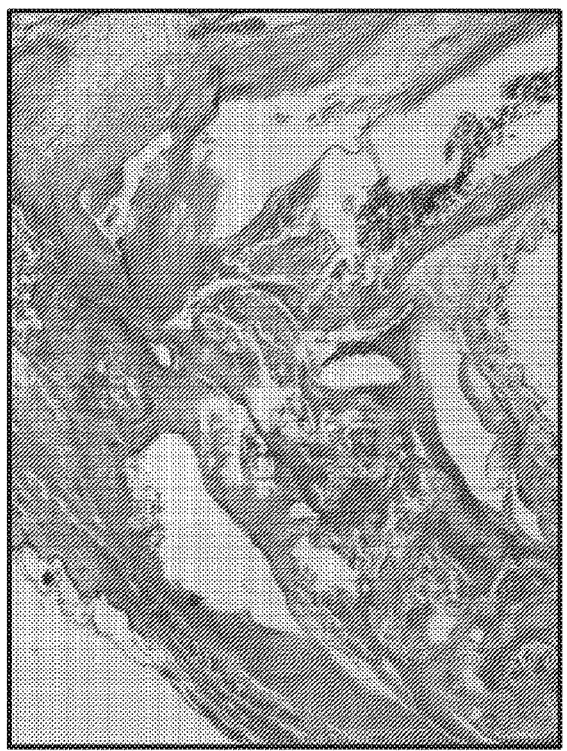
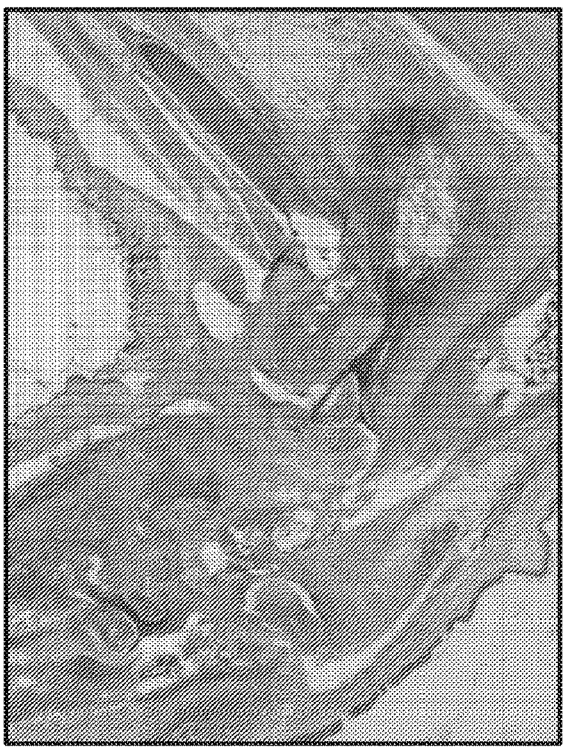
FIG. 69

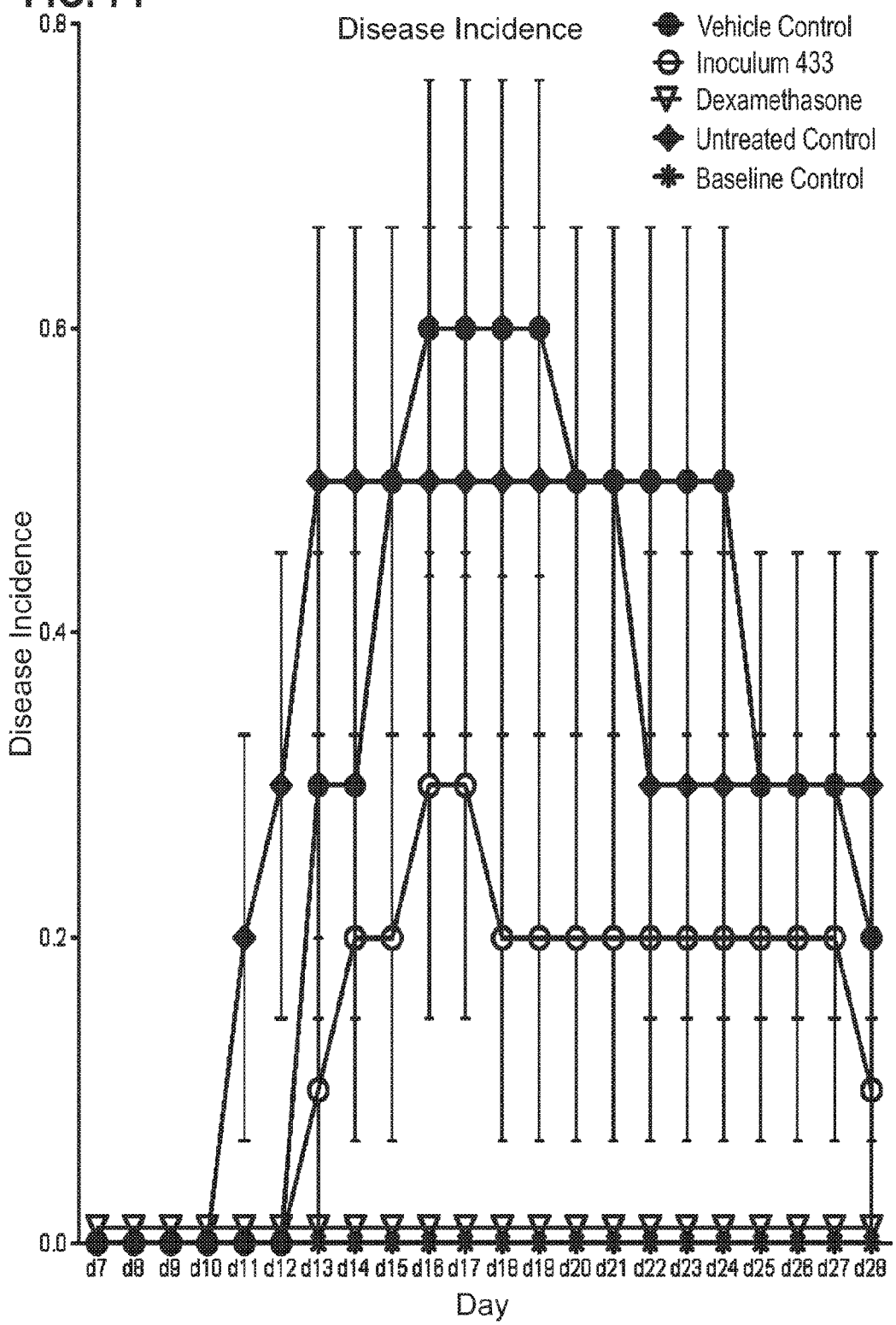

COMPOSITIONS COMPRISING BACTERIAL STRAINS

CROSS REFERENCE

This application is a continuation of International Application No. PCT/GB2016/051774, filed Jun. 15, 2016; which claims the benefit of Great Britain Patent Application No. 1510468.0, filed Jun. 15, 2015, and Great Britain Patent Application No. 1606807.4, filed Apr. 19, 2016, all of which are incorporated by reference herein in their entirety.

SEQUENCE LISTING

The instant application contains a Sequence Listing which has been submitted electronically in ASCII format and is hereby incorporated by reference in its entirety. Said ASCII copy, created on Jun. 7, 2017, is named 49455-715_301_SL.TXT and is 4,676,516 bytes in size.

TECHNICAL FIELD

This invention is in the field of compositions comprising bacterial strains isolated from the mammalian digestive tract and the use of such compositions in the treatment of disease.

BACKGROUND TO THE INVENTION

The human intestine is thought to be sterile in utero, but it is exposed to a large variety of maternal and environmental microbes immediately after birth. Thereafter, a dynamic period of microbial colonization and succession occurs, which is influenced by factors such as delivery mode, environment, diet and host genotype, all of which impact upon the composition of the gut microbiota, particularly during early life. Subsequently, the microbiota stabilizes and becomes adult-like [1]. The human gut microbiota contains more than 500-1000 different phylotypes belonging essentially to two major bacterial divisions, the Bacteroidetes and the Firmicutes [2]. The successful symbiotic relationships arising from bacterial colonization of the human gut have yielded a wide variety of metabolic, structural, protective and other beneficial functions. The enhanced metabolic activities of the colonized gut ensure that otherwise indigestible dietary components are degraded with release of by-products providing an important nutrient source for the host. Similarly, the immunological importance of the gut microbiota is well-recognized and is exemplified in germ-free animals which have an impaired immune system that is functionally reconstituted following the introduction of commensal bacteria [3-5].

Dramatic changes in microbiota composition have been documented in gastrointestinal disorders such as inflammatory bowel disease (IBD). For example, the levels of *Clostridium* cluster XIVa bacteria are reduced in IBD patients whilst numbers of *E. coli* are increased, suggesting a shift in the balance of symbionts and pathobionts within the gut [6-9]. Interestingly, this microbial dysbiosis is also associated with imbalances in T effector cell populations.

In recognition of the potential positive effect that certain bacterial strains may have on the animal gut, various strains have been proposed for use in the treatment of various diseases (see, for example, [10-13]). Also, certain strains, including mostly *Lactobacillus* and *Bifidobacterium* strains, have been proposed for use in treating various inflammatory and autoimmune diseases that are not directly linked to the intestines (see [14] and [15] for reviews). However, the relationship between different diseases and different bacterial strains, and the precise effects of particular bacterial strains on the gut and at a systemic level and on any particular types of diseases, are poorly characterised.

There is a requirement in the art for new methods of treating inflammatory and autoimmune diseases. There is also a requirement for the potential effects of gut bacteria to be characterised so that new therapies using gut bacteria can be developed.

SUMMARY OF THE INVENTION

The inventors have developed new therapies for treating and preventing inflammatory and autoimmune diseases. In particular, the inventors have developed new therapies for treating and preventing diseases and conditions mediated by IL-17 or the Th17 pathway. In particular, the inventors have identified that bacterial strains from the genus *Roseburia* can be effective for reducing the Th17 inflammatory response. As described in the examples, oral administration of compositions comprising *Roseburia hominis* may reduce the severity of the inflammatory response, including the Th17 inflammatory response, in mouse models of asthma, rheumatoid arthritis and multiple sclerosis.

Therefore, in a first embodiment, the invention provides a composition comprising a bacterial strain of the genus *Roseburia*, for use in a method of treating or preventing a disease or condition mediated by IL-17 or the Th17 pathway. The inventors have identified that treatment with bacterial strains from this genus can reduce levels of cytokines that are part of the Th17 pathway, including IL-17, can alleviate the Th17 inflammatory response and can provide clinical benefits in mouse models of inflammatory and autoimmune diseases mediated by IL-17 and the Th17 pathway.

In particular embodiments, the invention provides a composition comprising a bacterial strain of the genus *Roseburia*, for use in a method of treating or preventing a disease or condition selected from the group consisting of: multiple sclerosis; arthritis, such as rheumatoid arthritis, osteoarthritis, psoriatic arthritis, or juvenile idiopathic arthritis; neuromyelitis optica (Devic's disease); ankylosing spondylitis; spondyloarthritis; psoriasis; systemic lupus erythematosus; inflammatory bowel disease, such as Crohn's disease or ulcerative colitis; celiac disease; asthma, such as allergic asthma or neutrophilic asthma; chronic obstructive pulmonary disease (COPD); cancer, such as breast cancer, colon cancer, lung cancer or ovarian cancer; uveitis; scleritis; vasculitis; Behcet's disease; atherosclerosis; atopic dermatitis; emphysema; periodontitis; allergic rhinitis; and allograft rejection. The effect shown for the bacterial strains from the genus *Roseburia* on the Th17 inflammatory response may provide therapeutic benefits for diseases and conditions mediated by IL-17 and the Th17 pathway, such as those listed above.

In preferred embodiments, the invention provides a composition comprising a bacterial strain of the genus *Roseburia*, for use in a method of treating or preventing asthma, such as neutrophilic asthma or allergic asthma. The inventors have identified that treatment with *Roseburia* strains can reduce recruitment of neutrophils and eosinophils into the lungs, which can help treat or prevent asthma. Furthermore, the inventors have tested and demonstrated the efficacy of *Roseburia* strains in mouse models of asthma. In certain embodiments, the composition is for use in a method of treating or preventing neutrophilic asthma or eosinophilic asthma. The effect shown for the compositions of the invention on neutrophils and eosinophils mean that they may be particularly effective for treating or preventing neutrophilic asthma and eosinophilic asthma. Indeed, in certain embodiments, the composition is for use in a method of reducing a neutrophilic inflammatory response in the treatment or prevention of asthma, or the composition is for use in a method of reducing an eosinophilic inflammatory response in the treatment or prevention of asthma. In preferred embodiments, the invention provides a composition comprising a bacterial strain of the species *Roseburia hominis* for use in the treatment of asthma, and in particular eosinophilic or allergic asthma. *Roseburia hominis* is shown to have a particularly pronounced effect on eosinophils in asthma models and treatment with *Roseburia hominis* may be particularly effective for treating eosinophilic or allergic asthma.

In further preferred embodiments, the invention provides a composition comprising a bacterial strain of the genus *Roseburia*, for use in a method of treating or preventing rheumatoid arthritis. The inventors have identified that treatment with *Roseburia* strains can provide clinical benefits in a mouse model of rheumatoid arthritis and can reduce joint swelling. In preferred embodiments, the invention provides a composition comprising a bacterial strain of the species *Roseburia hominis*, for use in the treatment of rheumatoid arthritis. Compositions using *Roseburia hominis* may be particularly effective for treating rheumatoid arthritis.

In further preferred embodiments, the invention provides a composition comprising a bacterial strain of the genus *Roseburia*, for use in a method of treating or preventing multiple sclerosis. The inventors have identified that treatment with *Roseburia* strains can reduce disease incidence and disease severity in a mouse model of multiple sclerosis. In preferred embodiments, the invention provides a composition comprising a bacterial strain of the species *Roseburia hominis*, for use in the treatment of multiple sclerosis. Compositions using *Roseburia hominis* may be particularly effective for treating multiple sclerosis.

In certain embodiments, the compositions of the invention are for use in a method of reducing IL-17 production or reducing Th17 cell differentiation in the treatment or prevention of a disease or condition mediated by IL-17 or the Th17 pathway. In particular, the compositions of the invention may be used in reducing IL-17 production or reducing Th17 cell differentiation in the treatment or prevention of asthma, rheumatoid arthritis or multiple sclerosis. Preferably, the invention provides compositions comprising a bacterial strain of the species *Roseburia hominis*, for use in reducing IL-17 production or reducing Th17 cell differentiation in the treatment or prevention of asthma, rheumatoid arthritis or multiple sclerosis.

In certain embodiments, the composition is for use in a patient with elevated IL-17 levels or Th17 cells. The effect on the Th17 inflammatory response shown for *Roseburia* strains may be particularly beneficial for such patients.

In preferred embodiments of the invention, the bacterial strain in the composition is of *Roseburia hominis*. Closely related strains may also be used, such as bacterial strains that have a 16s rRNA sequence that is at least 95%, 96%, 97%, 98%, 99%, 99.5% or 99.9% identical to the 16s rRNA sequence of a bacterial strain of *Roseburia hominis*. Preferably, the bacterial strain has a 16s rRNA sequence that is at least 95%, 96%, 97%, 98%, 99%, 99.5% or 99.9% identical to SEQ ID NO: 1, 2 or 3. Preferably, the sequence identity is to SEQ ID NO:3. Preferably, the bacterial strain for use in the invention has the 16s rRNA sequence represented by SEQ ID NO:3.

In certain embodiments, the composition of the invention is for oral administration. Oral administration of the strains of the invention can be effective for treating IL-17- or Th17 pathway-mediated diseases and conditions. Also, oral administration is convenient for patients and practitioners and allows delivery to and/or partial or total colonisation of the intestine.

In certain embodiments, the composition of the invention comprises one or more pharmaceutically acceptable excipients or carriers.

In certain embodiments, the composition of the invention comprises a bacterial strain that has been lyophilised. Lyophilisation is an effective and convenient technique for preparing stable compositions that allow delivery of bacteria.

In certain embodiments, the invention provides a food product comprising the composition as described above.

In certain embodiments, the invention provides a vaccine composition comprising the composition as described above.

Additionally, the invention provides a method of treating or preventing a disease or condition mediated by IL-17 or the Th17 pathway, comprising administering a composition comprising a bacterial strain of the genus *Roseburia*.

In developing the above invention, the inventors have identified and characterised a bacterial strain that is particularly useful for therapy. The *Roseburia hominis* strain of the invention is shown to be effective for treating the diseases described herein, such as arthritis, asthma and multiple sclerosis. Therefore, in another aspect, the invention provides a cell of the *Roseburia hominis* strain deposited under accession number NCIMB 42383, or a derivative thereof. The invention also provides compositions comprising such cells, or biologically pure cultures of such cells. The invention also provides a cell of the *Roseburia hominis* strain deposited under accession number NCIMB 42383, or a derivative thereof, for use in therapy, in particular for the diseases described herein.

BRIEF DESCRIPTION OF DRAWINGS

FIG. 19: Mouse model of rheumatoid arthritis—Bodyweights, days −14 to 0. Data are presented as Mean±SEM percentages of the initial (Day −14) bodyweights.

FIG. 20: Mouse model of rheumatoid arthritis—Bodyweights, days 0 to 42. Data are presented as Mean±SEM percentages of the initial (Day 0) bodyweights.

FIG. 21: Mouse model of rheumatoid arthritis—Clinical Scores. Data are presented as Mean±SEM. **** $p<0.0001$ when compared to Day 21 in the vehicle-treated group.

FIG. 64: Mouse model of rheumatoid arthritis—Visual Template for Histopathology Scoring. Representative images showing composite scores from mouse tarsal joints in a collagen-induced arthritis study.

FIG. 69: Mouse model of rheumatoid arthritis—Histopathology: Representative Pictures. Animal ID (#n.n) and limb (R for right, L for left) are indicated between brackets. Left image (vehicle): extensive joint and bone destruction with inflammation and fibrosis extending to the peri-articular soft tissues.

FIG. 71: Mouse model of multiple sclerosis—disease incidence.

DISCLOSURE OF THE INVENTION

Bacterial Strains

Figure 1:
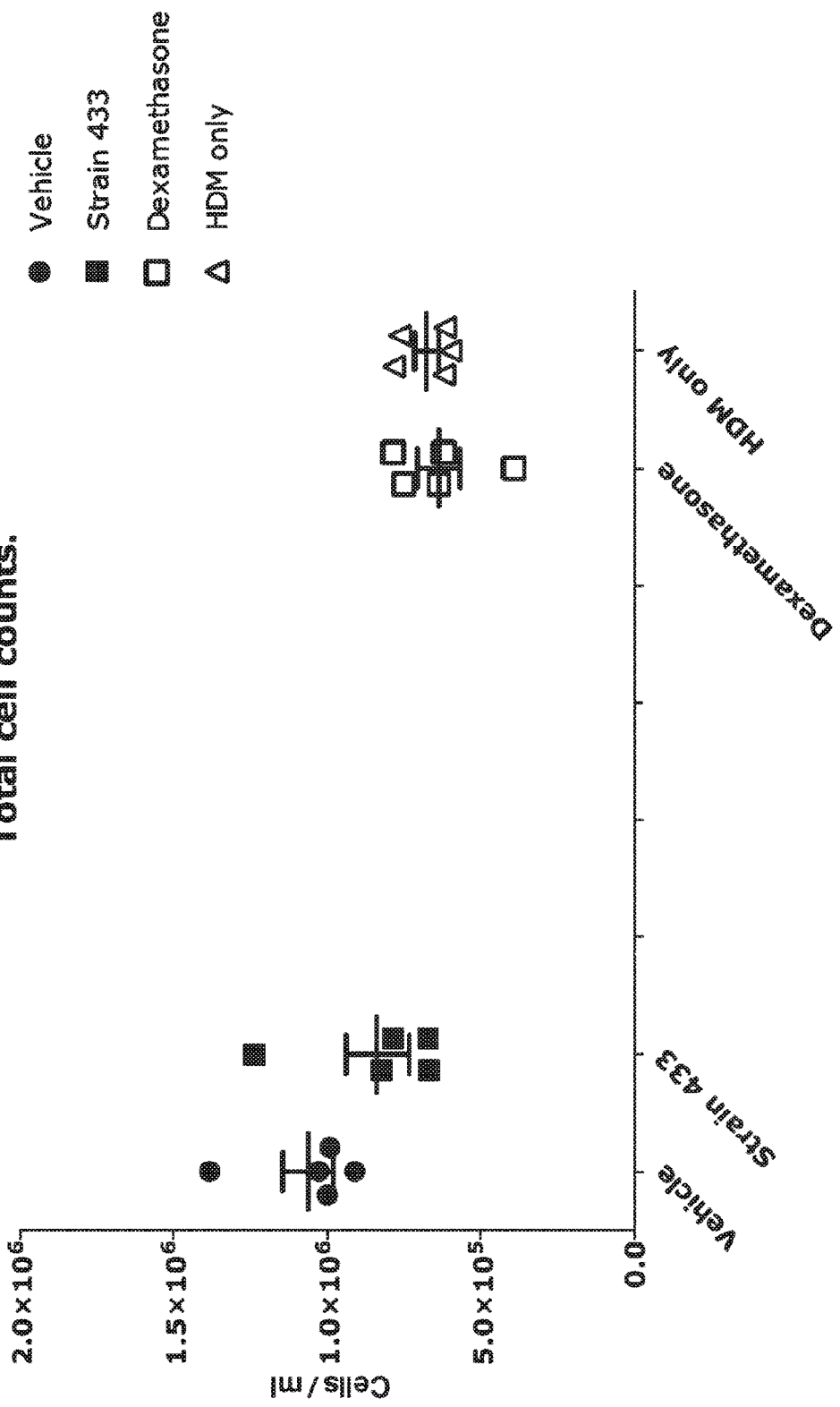
FIG. 1: Mouse model of house dust mite-induced asthma—Total BAL fluid cell counts.

The compositions of the invention comprise a bacterial strain of the genus *Roseburia*. The examples demonstrate that bacteria of this genus are useful for treating or preventing diseases and conditions mediated by IL-17 or the Th17 pathway. The preferred bacterial strains are of the species *Roseburia hominis*.

Examples of *Roseburia* species for use in the invention include *Roseburia hominis*, *Roseburia cecicola*, *Roseburia faecis*, *Roseburia intestinalis*, and *Roseburia inulinivorans*. *Roseburia* bacteria are slightly curved rod-shaped cells that are strictly anaerobic and indigenous to the mammalian intestine. They are of the phylogenetic cluster XIVa within the Firmicutes phylum. The bacteria are butyrate-producing and are actively motile through multiple flagella present along the concave side and in a cluster at one end [16]. *Roseburia hominis* and *Roseburia intestinalis* are recently described examples.

An example of *Roseburia hominis* is the strain deposited under the terms of the Budapest Treaty at National Collections of Industrial, Food and Marine Bacteria (NCIMB) at NCIMB Ltd, Ferguson Building, Craibstone Estate, Bucksburn, Aberdeen, UK, AB21 9YA, on 21 Oct. 2004 by the Rowett Research Institute under the accession number NCIMB 14029T *Roseburia hominis* A2-183T(DSM = 16839$_T$). Other exemplary *Roseburia hominis* strains are described in [17]. GenBank/EMBL/DDBJ accession numbers for the 16S rRNA gene sequence of strains of *Roseburia hominis* are AY804148 and AJ270482 (disclosed herein as SEQ ID NO:1 and SEQ ID NO:2).The NCIMB deposit was made under the terms of the Budapest Treaty. Maintenance of a viable culture is assured for 30 years from the date of deposit. All restrictions on the availability to the public of the deposited microorganism will be irrevocably removed upon the granting of a patent for this application.

An example of *Roseburia intestinalis* is the strain deposited under the accession number NCIMB 13810 *Roseburia intestinalis* L1-82$^T$(DSM=14610$^T$). Another example is the *Roseburia intestinalis* strain as described in [17]. Reference [17] also describes exemplary *Roseburia faecis* and *Roseburia inulinivorans* strains.

The Roseburia hominis bacterium deposited under accession number NCIMB 42383 was tested in the Examples and is also referred to herein as strain 433. A 16S rRNA sequence for the 433 strain that was tested is provided in SEQ ID NO:3. Strain 433 was deposited with the international depositary authority NCIMB, Ltd. (Ferguson Building, Aberdeen, AB21 9YA, Scotland) by GT Biologics Ltd. (Life Sciences Innovation Building, Aberdeen, AB25 2ZS, Scotland) on 12th Mar. 2015 as "*Roseburia hominis* 433" and was assigned accession number NCIMB 42383. GT Biologics Ltd. subsequently changed its name to 4D Pharma Research Limited. The NCIMB deposit was made under the terms of the Budapest Treaty. Maintenance of a viable culture is assured for 30 years from the date of deposit. All restrictions on the availability to the public of the deposited microorganism will be irrevocably removed upon the granting of a patent for this application.

A genome sequence for strain 433 is provided in SEQ ID NO:4. This sequence was generated using the PacBio RS II platform.

Bacterial strains closely related to the strain tested in the examples are also expected to be effective for treating or preventing diseases and conditions mediated by IL-17 or the Th17 pathway. In certain embodiments, the bacterial strain for use in the invention has a 16s rRNA sequence that is at least 95%, 96%, 97%, 98%, 99%, 99.5% or 99.9% identical to the 16s rRNA sequence of a bacterial strain of *Roseburia intestinalis*. Preferably, the bacterial strain for use in the invention has a 16s rRNA sequence that is at least 95%, 96%, 97%, 98%, 99%, 99.5% or 99.9% identical to SEQ ID NO: 1, 2 or 3. Preferably, the sequence identity is to SEQ ID NO:3. Preferably, the bacterial strain for use in the invention has the 16s rRNA sequence represented by SEQ ID NO:3.

Bacterial strains that are biotypes of the bacterium deposited under accession number 42383 are also expected to be effective for treating or preventing diseases and conditions mediated by IL-17 or the Th17 pathway. A biotype is a closely related strain that has the same or very similar physiological and biochemical characteristics.

Strains that are biotypes of the bacterium deposited under accession number NCIMB 42383 and that are suitable for use in the invention may be identified by sequencing other nucleotide sequences for the bacterium deposited under accession number NCIMB 42383. For example, substantially the whole genome may be sequenced and a biotype strain for use in the invention may have at least 95%, 96%, 97%, 98%, 99%, 99.5% or 99.9% sequence identity across at least 80% of its whole genome (e.g. across at least 85%, 90%, 95% or 99%, or across its whole genome). Other suitable sequences for use in identifying biotype strains may include hsp60 or repetitive sequences such as BOX, ERIC, (GTG)$_5$, or REP or [18]. Biotype strains may have sequences with at least 95%, 96%, 97%, 98%, 99%, 99.5% or 99.9% sequence identity to the corresponding sequence of the bacterium deposited under accession number NCIMB 42383.

In certain embodiments, the bacterial strain for use in the invention has a genome with sequence identity to SEQ ID NO:4. In preferred embodiments, the bacterial strain for use in the invention has a genome with at least 90% sequence identity (e.g. at least 92%, 94%, 95%, 96%, 97%, 98%, 99% or 100% sequence identity) to SEQ ID NO:4 across at least 60% (e.g. at least 65%, 70%, 75%, 80%, 85%, 95%, 96%, 97%, 98%, 99% or 100%) of SEQ ID NO:4. For example, the bacterial strain for use in the invention may have a genome with at least 90% sequence identity to SEQ ID NO:4 across 70% of SEQ ID NO:4, or at least 90% sequence identity to SEQ ID NO:4 across 80% of SEQ ID NO:4, or at least 90% sequence identity to SEQ ID NO:4 across 90% of SEQ ID NO:4, or at least 90% sequence identity to SEQ ID NO:4 across 100% of SEQ ID NO:4, or at least 95% sequence identity to SEQ ID NO:4 across 70% of SEQ ID NO:4, or at least 95% sequence identity to SEQ ID NO:4 across 80% of SEQ ID NO:4, or at least 95% sequence identity to SEQ ID NO:4 across 90% of SEQ ID NO:4, or at least 95% sequence identity to SEQ ID NO:4 across 100% of SEQ ID NO:4, or at least 98% sequence identity to SEQ ID NO:4 across 70% of SEQ ID NO:4, or at least 98% sequence identity to SEQ ID NO:4 across 80% of SEQ ID NO:4, or at least 98% sequence identity to SEQ ID NO:4 across 90% of SEQ ID NO:4, or at least 98% sequence identity to SEQ ID NO:4 across 100% of SEQ ID NO:4.

Alternatively, strains that are biotypes of the bacterium deposited under accession number NCIMB 42383 and that are suitable for use in the invention may be identified by using the accession number NCIMB 42383 deposit and restriction fragment analysis and/or PCR analysis, for example by using fluorescent amplified fragment length polymorphism (FAFLP) and repetitive DNA element (rep)-PCR fingerprinting, or protein profiling, or partial 16S or 23s rDNA sequencing. In preferred embodiments, such techniques may be used to identify other *Roseburia hominis* strains.

In certain embodiments, strains that are biotypes of the bacterium deposited under accession number NCIMB 42383 and that are suitable for use in the invention are strains that provide the same pattern as the bacterium deposited under accession number NCIMB 42383 when analysed by amplified ribosomal DNA restriction analysis (ARDRA), for example when using Sau3AI restriction enzyme (for exemplary methods and guidance see, for example, [19]). Alternatively, biotype strains are identified as strains that have the same carbohydrate fermentation patterns as the bacterium deposited under accession number NCIMB 42383.

Other *Roseburia* strains that are useful in the compositions and methods of the invention, such as biotypes of the bacteria deposited under accession number NCIMB 42383, may be identified using any appropriate method or strategy, including the assays described in the examples. For instance, strains for use in the invention may be identified by culturing in anaerobic YCFA and/or administering the bacteria to the type II collagen-induced arthritis mouse model and then assessing cytokine levels. In particular, bacterial strains that have similar growth patterns, metabolic type and/or surface antigens to the bacterium deposited under accession number NCIMB 42383 may be useful in the invention. A useful strain will have comparable immune modulatory activity to the NCIMB 42383 strain. In particular, a biotype strain will elicit comparable effects on the asthma, arthritis and multiple sclerosis disease models and comparable effects on cytokine levels to the effects shown in the Examples, which may be identified by using the culturing and administration protocols described in the Examples.

A particularly preferred strain of the invention is the *Roseburia hominis* strain deposited under accession number NCIMB 42383. This is the exemplary 433 strain tested in the examples and shown to be effective for treating disease. Therefore, the invention provides a cell, such as an isolated cell, of the *Roseburia hominis* strain deposited under accession number NCIMB 42383, or a derivative thereof. The invention also provides a composition comprising a cell of the *Roseburia hominis* strain deposited under accession number NCIMB 42383, or a derivative thereof. The invention also provides a biologically pure culture of the *Roseburia hominis* strain deposited under accession number NCIMB 42383. The invention also provides a cell of the *Roseburia hominis* strain deposited under accession number NCIMB 42383, or a derivative thereof, for use in therapy, in particular for the diseases described herein.

A derivative of the strain deposited under accession number NCIMB 42383 may be a daughter strain (progeny) or a strain cultured (subcloned) from the original. A derivative of a strain of the invention may be modified, for example at the genetic level, without ablating the biological activity. In particular, a derivative strain of the invention is therapeutically active. A derivative strain will have comparable immune modulatory activity to the original NCIMB 42383 strain. In particular, a derivative strain will elicit comparable effects on the asthma, arthritis and multiple sclerosis disease models and comparable effects on cytokine levels to the effects shown in the Examples, which may be identified by using the culturing and administration protocols described in the Examples. A derivative of the NCIMB 42383 strain will generally be a biotype of the NCIMB 42383 strain.

References to cells of the *Roseburia hominis* strain deposited under accession number NCIMB 42383 encompass any cells that have the same safety and therapeutic efficacy characteristics as the strains deposited under accession number NCIMB 42383, and such cells are encompassed by the invention.

In preferred embodiments, the bacterial strains in the compositions of the invention are viable and capable of partially or totally colonising the intestine.

Therapeutic Uses

As demonstrated in the examples, the bacterial compositions of the invention are effective for reducing the Th17 inflammatory response. In particular, treatment with compositions of the invention achieves a reduction in IL-17A levels and other Th17 pathway cytokines, and clinical improvements in animal models of conditions mediated by IL-17 and the Th17 pathway. Therefore, the compositions of the invention may be useful for treating or preventing inflammatory and autoimmune diseases, and in particular diseases or conditions mediated by IL-17. In particular, the compositions of the invention may be useful for reducing or preventing elevation of the IL-17 inflammatory response.

Th17 cells are a subset of T helper cells that produce, for example, IL-17A, IL17-F, IL-21 and IL-22. Th17 cell differentiation and IL-17 expression may be driven by IL-23. These cytokines and others form important parts of the Th17 pathway, which is a well-established inflammatory signalling pathway that contributes to and underlies a number of inflammatory and autoimmune diseases (as described in, for example, [20-25]). Diseases wherein the Th17 pathway is activated are Th17 pathway-mediated diseases. Th17 pathway-mediated diseases can be ameliorated or alleviated by repressing the Th17 pathway, which may be through a reduction in the differentiation of Th17 cells or a reduction in their activity or a reduction in the level of Th17 pathway cytokines. Diseases mediated by the Th17 pathway may be characterised by increased levels of cytokines produced by Th17 cells, such as IL-17A, IL-17F, IL-21, IL-22, IL-26, IL-9 (reviewed in [26]). Diseases mediated by the Th17 pathway may be characterised by increased expression of Th-17-related genes, such as Stat3 or IL-23R. Diseases mediated by the Th17 pathway may be associated with increased levels of Th17 cells.

IL-17 is a pro-inflammatory cytokine that contributes to the pathogenesis of several inflammatory and autoimmune diseases and conditions. IL-17 as used herein may refer to any member of the IL-17 family, including IL-17A, IL-17B, IL-17C, IL-17D, IL-17E, and IL-17F. IL-17-mediated diseases and conditions are characterised by high expression of IL-17 and/or the accumulation or presence of IL-17-positive cells in a tissue affected by the disease or condition. Similarly, IL-17-mediated diseases and conditions are diseases and conditions that are exacerbated by high IL-17 levels or an increase in IL-17 levels, and that are alleviated by low IL-17 levels or a reduction in IL-17 levels. The IL-17 inflammatory response may be local or systemic.

Examples of diseases and conditions that may be mediated by IL-17 or the Th17 pathway include multiple sclerosis; arthritis, such as rheumatoid arthritis, osteoarthritis, psoriatic arthritis, or juvenile idiopathic arthritis; neuromyelitis optica (Devic's disease); ankylosing spondylitis; spondyloarthritis; psoriasis; systemic lupus erythematosus; inflammatory bowel disease, such as Crohn's disease or ulcerative colitis; celiac disease; asthma, such as allergic asthma or neutrophilic asthma; chronic obstructive pulmonary disease (COPD); cancer, such as breast cancer, colon cancer, lung cancer or ovarian cancer; uveitis; scleritis; vasculitis; Behcet's disease; atherosclerosis; atopic dermatitis; emphysema; periodontitis; allergic rhinitis; and allograft rejection. In preferred embodiments, the compositions of the invention are used for treating or preventing one or more of these conditions or diseases. In further preferred embodiments, these conditions or diseases are mediated by IL-17 or the Th17 pathway.

In certain embodiments, the compositions of the invention are for use in a method of reducing IL-17 production or reducing Th17 cell differentiation in the treatment or prevention of a disease or condition mediated by IL-17 or the Th17 pathway. In certain embodiments, the compositions of the invention are for use in treating or preventing an inflammatory or autoimmune disease, wherein said treatment or prevention is achieved by reducing or preventing elevation of the Th17 inflammatory response. In certain embodiments, the compositions of the invention are for use in treating a patient with an inflammatory or autoimmune disease, wherein the patient has elevated IL-17 levels or elevated Th17 cells or is exhibiting a Th17 inflammatory response. In certain embodiments, the patient may have been diagnosed with a chronic inflammatory or autoimmune disease or condition, or the composition of the invention may be for use in preventing an inflammatory or autoimmune disease or condition developing into a chronic inflammatory or autoimmune disease or condition. In certain embodiments, the disease or condition may not be responsive to treatment with TNF-α inhibitors. These uses of the invention may be applied to any of the specific disease or conditions listed in the preceding paragraph.

IL-17 and the Th17 pathway are often associated with chronic inflammatory and autoimmune diseases, so the compositions of the invention may be particularly useful for treating or preventing chronic diseases or conditions as listed above. In certain embodiments, the compositions are for use in patients with chronic disease. In certain embodiments, the compositions are for use in preventing the development of chronic disease.

The compositions of the invention may be useful for treating diseases and conditions mediated by IL-17 or the Th17 pathway and for addressing the Th17 inflammatory response, so the compositions of the invention may be particularly useful for treating or preventing chronic disease, treating or preventing disease in patients that have not responded to other therapies (such as treatment with TNF-α inhibitors), and/or treating or preventing the tissue damage and symptoms associated with IL-17 and Th17 cells. For example, IL-17 is known to activate matrix destruction in cartilage and bone tissue and IL-17 has an inhibitory effect on matrix production in chondrocytes and osteoblasts, so the compositions of the invention may be useful for treating or preventing bone erosion or cartilage damage.

In certain embodiments, treatment with compositions of the invention provides a reduction or prevents an elevation in IL-17 levels, in particular IL-17A levels. In certain embodiments, treatment with compositions of the invention provides a reduction or prevents an elevation in IFN-γ or IL-6 levels. Such reduction or prevention of elevated levels of these cytokines may be useful for treating or preventing inflammatory and autoimmune diseases and conditions, in particular those mediated by IL-17 or the Th17 pathway.

Asthma

In preferred embodiments, the compositions of the invention are for use in treating or preventing asthma. The examples demonstrate that the compositions of the invention achieve a reduction in the recruitment of neutrophils and/or eosinophils into the airways following sensitisation and challenge with house dust mite extract and so they may be useful in the treatment or prevention of asthma.

Asthma is a chronic disease characterised by inflammation and restriction of the airways. The inflammation in asthma may be mediated by IL-17 and/or Th17 cells, and so the compositions of the invention may be particularly effective for preventing or treating asthma. The inflammation in asthma may be mediated by eosinophils and/or neutrophils.

In certain embodiments, the asthma is eosinophilic or allergic asthma. Eosinophilic and allergic asthma are characterised by increased numbers of eosinophils in peripheral blood and in airway secretions and is associated pathologically with thickening of the basement membrane zone and pharmacologically by corticosteroid responsiveness [27]. Compositions that reduce or inhibit eosinophil recruitment or activation may be useful for treating or preventing eosinophilic and allergic asthma.

In additional embodiments, the compositions of the invention are for use in treating or preventing neutrophilic asthma (or non-eosinophilic asthma). High neutrophil numbers are associated with severe asthma that may be insensitive to corticosteroid treatment. Compositions that reduce or inhibit neutrophil recruitment or activation may be useful for treating or preventing neutrophilic asthma.

Eosinophilic and neutrophilic asthma are not mutually exclusive conditions and treatments that help address either the eosinophil and neutrophil responses may be useful for treating asthma in general.

Increased IL-17 levels and activation of the Th17 pathway are associated with severe asthma, so the compositions of the invention may be useful for preventing the development of severe asthma or for treating severe asthma.

In certain embodiments, the compositions of the invention are for use in methods reducing an eosinophilic inflammatory response in the treatment or prevention of asthma, or for use in methods of reducing a neutrophilic inflammatory response in the treatment or prevention of asthma. As noted above, high levels of eosinophils in asthma is associated pathologically with thickening of the basement membrane zone, so reducing eosinophilic inflammatory response in the treatment or prevention of asthma may be able to specifically address this feature of the disease. Also, elevated neutrophils, either in combination with elevated eosinophils or in their absence, is associated with severe asthma and chronic airway narrowing. Therefore, reducing the neutrophilic inflammatory response may be particularly useful for addressing severe asthma.

In certain embodiments, the compositions reduce peribronchiolar infiltration in allergic asthma, or are for use in reducing peribronchiolar infiltration in the treatment of allergic asthma. In certain embodiments, the compositions reduce peribronchiolar and/or perivascular infiltration in neutrophilic asthma, or are for use in reducing peribronchiolar and/or perivascular infiltration in the treatment of allergic neutrophilic asthma.

In certain embodiments, treatment with compositions of the invention provides a reduction or prevents an elevation in IFNγ levels.

In certain embodiments, the compositions of the invention are for use in a method of treating asthma that results in a reduction of the eosinophilic and/or neutrophilic inflammatory response. In certain embodiments, the patient to be treated has, or has previously been identified as having, elevated neutrophil or eosinophil levels, for example as identified through blood sampling or sputum analysis.

The compositions of the invention may be useful for preventing the development of asthma in a new-born when administered to the new-born, or to a pregnant woman. The compositions may be useful for preventing the development of asthma in children. The compositions of the invention may be useful for treating or preventing adult-onset asthma. The compositions of the invention may be useful for managing or alleviating asthma. The compositions of the invention may be particularly useful for reducing symptoms associated with asthma that is aggravated by allergens, such as house dust mites. Treatment or prevention of asthma may refer to, for example, an alleviation of the severity of symptoms or a reduction in the frequency of exacerbations or the range of triggers that are a problem for the patient.

Arthritis

In preferred embodiments, the compositions of the invention are for use in treating or preventing rheumatoid arthritis (RA). The examples demonstrate that the compositions of the invention achieve a reduction in the clinical signs of RA in a mouse model, reduce cartilage and bone damage, and reduce the IL-17 inflammatory response, and so they may be useful in the treatment or prevention of RA. RA is a systemic inflammatory disorder that primarily affects joints. RA is associated with an inflammatory response that results in swelling of joints, synovial hyperplasia, and destruction of cartilage and bone. IL-17 and Th17 cells may have a key role in RA, for example because IL-17 inhibits matrix production in chondrocytes and osteoblasts and activates the production and function of matrix metalloproteinases and because RA disease activity is correlated to IL-17 levels and Th-17 cell numbers [28, 29], so the compositions of the invention may be particularly effective for preventing or treating RA.

In certain embodiments, the compositions of the invention are for use in lowering IL-17 levels or preventing elevation of IL-17 levels in the treatment or prevention of RA. In certain embodiments, treatment with compositions of the invention provides a reduction or prevents an elevation in IL-17 levels, in particular IL-17A levels. In certain embodiments, treatment with compositions of the invention provides a reduction or prevents an elevation in IFN-γ or IL-6 levels.

In certain embodiments, treatment with the compositions of the invention results in a reduction in the swelling of joints. In certain embodiments, the compositions of the invention are for use in patients with swollen joints or patients identified as at risk of having swollen joints. In certain embodiments, the compositions of the invention are for use in a method of reducing joint swelling in RA.

In certain embodiments, treatment with the compositions of the invention results in a reduction in cartilage damage or bone damage. In certain embodiments, the compositions of the invention are for use in reducing or preventing cartilage or bone damage in the treatment of RA. In certain embodiments, the compositions are for use in treating patient with severe RA that are at risk of cartilage or bone damage.

Increased IL-17 levels and Th17 cell numbers are associated with cartilage and bone destruction in RA [28, 29]. IL-17 is known to activate matrix destruction in cartilage and bone tissue and IL-17 has an inhibitory effect on matrix production in chondrocytes and osteoblasts. Therefore, in certain embodiments, the compositions of the invention are for use in preventing bone erosion or cartilage damage in the treatment of RA. In certain embodiments, the compositions are for use in treating patients that exhibit bone erosion or cartilage damage or patients identified as at risk of bone erosion or cartilage damage.

TNF-α is also associated with RA, but TNF-α is not involved in the pathogenesis of the later stages of the disease. In contrast, IL-17 has a role throughout all stages of chronic disease [30]. Therefore, in certain embodiments the compositions of the invention are for use in treating chronic RA or late-stage RA, such as disease that includes joint destruction and loss of cartilage. In certain embodiments, the compositions of the invention are for treating patients that have previously received anti-TNF-α therapy. In certain embodiments, the patients to be treated do not respond or no longer respond to anti-TNF-α therapy.

The compositions of the invention may be useful for modulating a patient's immune system, so in certain embodiments the compositions of the invention are for use in preventing RA in a patient that has been identified as at risk of RA, or that has been diagnosed with early-stage RA. The compositions of the invention may be useful for preventing the development of RA.

The compositions of the invention may be useful for managing or alleviating RA. The compositions of the invention may be particularly useful for reducing symptoms associated with joint swelling or bone destruction. Treatment or prevention of RA may refer to, for example, an alleviation of the severity of symptoms or a reduction in the frequency of exacerbations or the range of triggers that are a problem for the patient.

Multiple Sclerosis

In preferred embodiments, the compositions of the invention are for use in treating or preventing multiple sclerosis. The examples demonstrate that the compositions of the invention achieve a reduction in the disease incidence and disease severity in a mouse model of multiple sclerosis (the EAE model), and so they may be useful in the treatment or prevention of multiple sclerosis. Multiple sclerosis is an inflammatory disorder associated with damage to the myelin sheaths of neurons, particularly in the brain and spinal column. Multiple sclerosis is a chronic disease, which is progressively incapacitating and which evolves in episodes. IL-17 and Th17 cells may have a key role in multiple sclerosis, for example because IL-17 levels may correlate with multiple sclerosis lesions, IL-17 can disrupt blood brain barrier endothelial cell tight junctions, and Th17 cells can migrate into the central nervous system and cause neuronal loss [31, 32]. Therefore, the compositions of the invention may be particularly effective for preventing or treating multiple sclerosis.

In certain embodiments, treatment with the compositions of the invention results in a reduction in disease incidence or disease severity. In certain embodiments, the compositions of the invention are for use in reducing disease incidence or disease severity. In certain embodiments, treatment with the compositions of the invention prevents a decline in motor function or results in improved motor function. In certain embodiments, the compositions of the invention are for use in preventing a decline in motor function or for use in improving motor function. In certain embodiments, treatment with the compositions of the invention prevents the development of paralysis. In certain embodiments, the compositions of the invention are for use in preventing paralysis in the treatment of multiple sclerosis.

The compositions of the invention may be useful for modulating a patient's immune system, so in certain embodiments the compositions of the invention are for use in preventing multiple sclerosis in a patient that has been identified as at risk of multiple sclerosis, or that has been diagnosed with early-stage multiple sclerosis or "relapsing-remitting" multiple sclerosis. The compositions of the invention may be useful for preventing the development of sclerosis. Indeed, the examples show that administration of compositions of the invention prevented the development of disease in many mice.

The compositions of the invention may be useful for managing or alleviating multiple sclerosis. The compositions of the invention may be particularly useful for reducing symptoms associated with multiple sclerosis. Treatment or prevention of multiple sclerosis may refer to, for example, an alleviation of the severity of symptoms or a reduction in the frequency of exacerbations or the range of triggers that are a problem for the patient.

Modes of Administration

Preferably, the compositions of the invention are to be administered to the gastrointestinal tract in order to enable delivery to and/or partial or total colonisation of the intestine with the bacterial strain of the invention. Generally, the compositions of the invention are administered orally, but they may be administered rectally, intranasally, or via buccal or sublingual routes.

In certain embodiments, the compositions of the invention may be administered as a foam, as a spray or a gel.

In certain embodiments, the compositions of the invention may be administered as a suppository, such as a rectal suppository, for example in the form of a *theobroma* oil (cocoa butter), synthetic hard fat (e.g. suppocire, witepsol), glycero-gelatin, polyethylene glycol, or soap glycerin composition.

In certain embodiments, the composition of the invention is administered to the gastrointestinal tract via a tube, such as a nasogastric tube, orogastric tube, gastric tube, jejunostomy tube (J tube), percutaneous endoscopic gastrostomy (PEG), or a port, such as a chest wall port that provides access to the stomach, jejunum and other suitable access ports.

The compositions of the invention may be administered once, or they may be administered sequentially as part of a treatment regimen. In certain embodiments, the compositions of the invention are to be administered daily.

In certain embodiments of the invention, treatment according to the invention is accompanied by assessment of the patient's gut microbiota. Treatment may be repeated if delivery of and/or partial or total colonisation with the strain of the invention is not achieved such that efficacy is not observed, or treatment may be ceased if delivery and/or partial or total colonisation is successful and efficacy is observed.

In certain embodiments, the composition of the invention may be administered to a pregnant animal, for example a mammal such as a human in order to prevent an inflammatory or autoimmune disease developing in her child in utero and/or after it is born.

The compositions of the invention may be administered to a patient that has been diagnosed with a disease or condition mediated by IL-17 or the Th17 pathway, or that has been identified as being at risk of a disease or condition mediated by IL-17 or the Th17 pathway. The compositions may also be administered as a prophylactic measure to prevent the development of diseases or conditions mediated by IL-17 or the Th17 pathway in a healthy patient.

The compositions of the invention may be administered to a patient that has been identified as having an abnormal gut microbiota. For example, the patient may have reduced or absent colonisation by *Roseburia*, and in particular *Roseburia hominis*.

The compositions of the invention may be administered as a food product, such as a nutritional supplement.

Generally, the compositions of the invention are for the treatment of humans, although they may be used to treat animals including monogastric mammals such as poultry, pigs, cats, dogs, horses or rabbits. The compositions of the invention may be useful for enhancing the growth and performance of animals. If administered to animals, oral gavage may be used.

Compositions

Generally, the composition of the invention comprises bacteria. In preferred embodiments of the invention, the composition is formulated in freeze-dried form. For example, the composition of the invention may comprise granules or gelatin capsules, for example hard gelatin capsules, comprising a bacterial strain of the invention.

Preferably, the composition of the invention comprises lyophilised bacteria. Lyophilisation of bacteria is a well-established procedure and relevant guidance is available in, for example, references [33-35].

Alternatively, the composition of the invention may comprise a live, active bacterial culture.

In preferred embodiments, the composition of the invention is encapsulated to enable delivery of the bacterial strain to the intestine. Encapsulation protects the composition from degradation until delivery at the target location through, for example, rupturing with chemical or physical stimuli such as pressure, enzymatic activity, or physical disintegration, which may be triggered by changes in pH. Any appropriate encapsulation method may be used. Exemplary encapsulation techniques include entrapment within a porous matrix, attachment or adsorption on solid carrier surfaces, self-aggregation by flocculation or with cross-linking agents, and mechanical containment behind a microporous membrane or a microcapsule. Guidance on encapsulation that may be useful for preparing compositions of the invention is available in, for example, references [36] and [37].

The composition may be administered orally and may be in the form of a tablet, capsule or powder. Encapsulated products are preferred because *Roseburia* are anaerobes. Other ingredients (such as vitamin C, for example), may be included as oxygen scavengers and prebiotic substrates to improve the delivery and/or partial or total colonisation and survival in vivo. Alternatively, the probiotic composition of the invention may be administered orally as a food or nutritional product, such as milk or whey based fermented dairy product, or as a pharmaceutical product.

The composition may be formulated as a probiotic.

A composition of the invention includes a therapeutically effective amount of a bacterial strain of the invention. A therapeutically effective amount of a bacterial strain is sufficient to exert a beneficial effect upon a patient. A therapeutically effective amount of a bacterial strain may be sufficient to result in delivery to and/or partial or total colonisation of the patient's intestine.

A suitable daily dose of the bacteria, for example for an adult human, may be from about $1 \times 10^3$ to about $1 \times 10^{11}$ colony forming units (CFU); for example, from about $1 \times 10^7$ to about $1 \times 10^{10}$ CFU; in another example from about $1 \times 10^6$ to about $1 \times 10^{10}$ CFU.

In certain embodiments, the composition contains the bacterial strain in an amount of from about $1 \times 10^6$ to about $1 \times 10^{11}$ CFU/g, respect to the weight of the composition; for example, from about $1\times10^8$ to about $1\times10^{10}$ CFU/g. The dose may be, for example, 1 g, 3 g, 5 g, and 10 g.

Typically, a probiotic, such as the composition of the invention, is optionally combined with at least one suitable prebiotic compound. A prebiotic compound is usually a non-digestible carbohydrate such as an oligo- or polysaccharide, or a sugar alcohol, which is not degraded or absorbed in the upper digestive tract. Known prebiotics include commercial products such as inulin and transgalacto-oligosaccharides.

In certain embodiments, the probiotic composition of the present invention includes a prebiotic compound in an amount of from about 1 to about 30% by weight, respect to the total weight composition, (e.g. from 5 to 20% by weight). Carbohydrates may be selected from the group consisting of: fructo-oligosaccharides (or FOS), short-chain fructo-oligosaccharides, inulin, isomalt-oligosaccharides, pectins, xylo-oligosaccharides (or XOS), chitosan-oligosaccharides (or COS), beta-glucans, arable gum modified and resistant starches, polydextrose, D-tagatose, acacia fibers, carob, oats, and citrus fibers. In one aspect, the prebiotics are the short-chain fructo-oligosaccharides (for simplicity shown herein below as FOSs-c.c); said FOSs-c.c. are not digestible carbohydrates, generally obtained by the conversion of the beet sugar and including a saccharose molecule to which three glucose molecules are bonded.

The compositions of the invention may comprise pharmaceutically acceptable excipients or carriers. Examples of such suitable excipients may be found in the reference [38]. Acceptable carriers or diluents for therapeutic use are well known in the pharmaceutical art and are described, for example, in reference [39]. Examples of suitable carriers include lactose, starch, glucose, methyl cellulose, magnesium stearate, mannitol, sorbitol and the like. Examples of suitable diluents include ethanol, glycerol and water. The choice of pharmaceutical carrier, excipient or diluent can be selected with regard to the intended route of administration and standard pharmaceutical practice. The pharmaceutical compositions may comprise as, or in addition to, the carrier, excipient or diluent any suitable binder(s), lubricant(s), suspending agent(s), coating agent(s), solubilising agent(s). Examples of suitable binders include starch, gelatin, natural sugars such as glucose, anhydrous lactose, free-flow lactose, beta-lactose, corn sweeteners, natural and synthetic gums, such as acacia, tragacanth or sodium alginate, carboxymethyl cellulose and polyethylene glycol. Examples of suitable lubricants include sodium oleate, sodium stearate, magnesium stearate, sodium benzoate, sodium acetate, sodium chloride and the like. Preservatives, stabilizers, dyes and even flavouring agents may be provided in the pharmaceutical composition. Examples of preservatives include sodium benzoate, sorbic acid and esters of p-hydroxybenzoic acid. Antioxidants and suspending agents may be also used.

The compositions of the invention may be formulated as a food product. For example, a food product may provide nutritional benefit in addition to the therapeutic effect of the invention, such as in a nutritional supplement. Similarly, a food product may be formulated to enhance the taste of the composition of the invention or to make the composition more attractive to consume by being more similar to a common food item, rather than to a pharmaceutical composition. In certain embodiments, the composition of the invention is formulated as a milk-based product. The term "milk-based product" means any liquid or semi-solid milk- or whey-based product having a varying fat content. The milk-based product can be, e.g., cow's milk, goat's milk, sheep's milk, skimmed milk, whole milk, milk recombined from powdered milk and whey without any processing, or a processed product, such as yoghurt, curdled milk, curd, sour milk, sour whole milk, butter milk and other sour milk products. Another important group includes milk beverages, such as whey beverages, fermented milks, condensed milks, infant or baby milks; flavoured milks, ice cream; milk-containing food such as sweets.

In certain embodiments, the compositions of the invention contain a single bacterial strain or species and do not contain any other bacterial strains or species. Such compositions may comprise only de minimis or biologically irrelevant amounts of other bacterial strains or species. Such compositions may be a culture that is substantially free from other species of organism.

The compositions for use in accordance with the invention may or may not require marketing approval.

In some cases, the lyophilised bacterial strain is reconstituted prior to administration. In some cases, the reconstitution is by use of a diluent described herein.

The compositions of the invention can comprise pharmaceutically acceptable excipients, diluents or carriers.

In certain embodiments, the invention provides a pharmaceutical composition comprising: a bacterial strain of the invention; and a pharmaceutically acceptable excipient, carrier or diluent; wherein the bacterial strain is in an amount sufficient to treat a disorder when administered to a subject in need thereof; and wherein the disorder is selected from the group consisting of asthma, allergic asthma, neutrophilic asthma, osteoarthritis, psoriatic arthritis, juvenile idiopathic arthritis, neuromyelitis optica (Devic's disease), ankylosing spondylitis, spondyloarthritis, systemic lupus erythematosus, celiac disease, chronic obstructive pulmonary disease (COPD), cancer, breast cancer, colon cancer, lung cancer, ovarian cancer, uveitis, scleritis, vasculitis, Behcet's disease, atherosclerosis, atopic dermatitis, emphysema, periodontitis, allergic rhinitis, and allograft rejection.

In certain embodiments, the invention provides pharmaceutical composition comprising: a bacterial strain of the invention; and a pharmaceutically acceptable excipient, carrier or diluent; wherein the bacterial strain is in an amount sufficient to treat or prevent a disease or condition mediated by IL-17 or the Th17 pathway. In preferred embodiments, said disease or condition is selected from the group consisting of rheumatoid arthritis, multiple sclerosis, psoriasis, inflammatory bowel disease, Crohn's disease, ulcerative colitis, celiac disease, asthma, allergic asthma, neutrophilic asthma, osteoarthritis, psoriatic arthritis, juvenile idiopathic arthritis, neuromyelitis optica (Devic's disease), ankylosing spondylitis, spondyloarthritis, systemic lupus erythematosus, chronic obstructive pulmonary disease (COPD), cancer, breast cancer, colon cancer, lung cancer, ovarian cancer, uveitis, scleritis, vasculitis, Behcet's disease, atherosclerosis, atopic dermatitis, emphysema, periodontitis, allergic rhinitis, and allograft rejection.

In certain embodiments, the invention provides the above pharmaceutical composition, wherein the amount of the bacterial strain is from about $1\times10^3$ to about $1\times10^1$ colony forming units per gram with respect to a weight of the composition.

In certain embodiments, the invention provides the above pharmaceutical composition, wherein the composition is administered at a dose of 1 g, 3 g, 5 g or 10 g.

In certain embodiments, the invention provides the above pharmaceutical composition, wherein the composition is administered by a method selected from the group consisting of oral, rectal, subcutaneous, nasal, buccal, and sublingual.

In certain embodiments, the invention provides the above pharmaceutical composition, comprising a carrier selected from the group consisting of lactose, starch, glucose, methyl cellulose, magnesium stearate, mannitol and sorbitol.

In certain embodiments, the invention provides the above pharmaceutical composition, comprising a diluent selected from the group consisting of ethanol, glycerol and water.

In certain embodiments, the invention provides the above pharmaceutical composition, comprising an excipient selected from the group consisting of starch, gelatin, glucose, anhydrous lactose, free-flow lactose, beta-lactose, corn sweetener, acacia, tragacanth, sodium alginate, carboxymethyl cellulose, polyethylene glycol, sodium oleate, sodium stearate, magnesium stearate, sodium benzoate, sodium acetate and sodium chloride.

In certain embodiments, the invention provides the above pharmaceutical composition, further comprising at least one of a preservative, an antioxidant and a stabilizer.

In certain embodiments, the invention provides the above pharmaceutical composition, comprising a preservative selected from the group consisting of sodium benzoate, sorbic acid and esters of p-hydroxybenzoic acid.

In certain embodiments, the invention provides the above pharmaceutical composition, wherein said bacterial strain is lyophilised.

In certain embodiments, the invention provides the above pharmaceutical composition, wherein when the composition is stored in a sealed container at about 4° C. or about 25° C. and the container is placed in an atmosphere having 50% relative humidity, at least 80% of the bacterial strain as measured in colony forming units, remains after a period of at least about: 1 month, 3 months, 6 months, 1 year, 1.5 years, 2 years, 2.5 years or 3 years.

Culturing Methods

The bacterial strains for use in the present invention can be cultured using standard microbiology techniques as detailed in, for example, references [40-42].

The solid or liquid medium used for culture may be YCFA agar or YCFA medium. YCFA medium may include (per 100 ml, approximate values): Casitone (1.0 g), yeast extract (0.25 g), NaHCO$_3$ (0.4 g), cysteine (0.1 g), K$_2$HPO$_4$ (0.045 g), KH$_2$PO$_4$ (0.045 g), NaCl (0.09 g), (NH$_4$)$_2$SO$_4$ (0.09 g), MgSO$_4$.7H$_2$O (0.009 g), CaCl$_2$ (0.009 g), resazurin (0.1 mg), hemin (1 mg), biotin (1 µg), cobalamin (1 µg), p-aminobenzoic acid (3 µg), folic acid (5 µg), and pyridoxamine (15 µg).

Bacterial Strains for Use in Vaccine Compositions

The inventors have identified that the bacterial strains of the invention are useful for treating or preventing diseases or conditions mediated by IL-17 or the Th17 pathway. This is likely to be a result of the effect that the bacterial strains of the invention have on the host immune system. Therefore, the compositions of the invention may also be useful for preventing diseases or conditions mediated by IL-17 or the Th17 pathway, when administered as vaccine compositions. In certain such embodiments, the bacterial strains of the invention may be killed, inactivated or attenuated. In certain such embodiments, the compositions may comprise a vaccine adjuvant. In certain embodiments, the compositions are for administration via injection, such as via subcutaneous injection.

General

The practice of the present invention will employ, unless otherwise indicated, conventional methods of chemistry, biochemistry, molecular biology, immunology and pharmacology, within the skill of the art. Such techniques are explained fully in the literature. See, e.g., references [43] and [44-50], etc.

The term "comprising" encompasses "including" as well as "consisting" e.g. a composition "comprising" X may consist exclusively of X or may include something additional e.g. X+Y.

The term "about" in relation to a numerical value x is optional and means, for example, x±10%.

The word "substantially" does not exclude "completely" e.g. a composition which is "substantially free" from Y may be completely free from Y. Where necessary, the word "substantially" may be omitted from the definition of the invention.

References to a percentage sequence identity between two nucleotide sequences means that, when aligned, that percentage of nucleotides are the same in comparing the two sequences. This alignment and the percent homology or sequence identity can be determined using software programs known in the art, for example those described in section 7.7.18 of ref. [51]. A preferred alignment is determined by the Smith-Waterman homology search algorithm using an affine gap search with a gap open penalty of 12 and a gap extension penalty of 2, BLOSUM matrix of 62. The Smith-Waterman homology search algorithm is disclosed in ref. [52].

Unless specifically stated, a process or method comprising numerous steps may comprise additional steps at the beginning or end of the method, or may comprise additional intervening steps. Also, steps may be combined, omitted or performed in an alternative order, if appropriate.

Various embodiments of the invention are described herein. It will be appreciated that the features specified in each embodiment may be combined with other specified features, to provide further embodiments. In particular, embodiments highlighted herein as being suitable, typical or preferred may be combined with each other (except when they are mutually exclusive).

MODES FOR CARRYING OUT THE INVENTION

Example 1

Efficacy of Bacterial Inocula in a Mouse Model of House Dust Mite-Induced Asthma Summary Mice were administered with compositions comprising bacterial strains according to the invention and were subsequently challenged with house dust mite (HDM) extract to elicit an allergic inflammatory response. The inflammatory response to HDM includes eosinophilic and neutrophilic components, is mediated by IL-17 and the Th17 pathway, and is a model for asthma. The magnitude and characteristics of the inflammatory response exhibited by mice treated with compositions of the invention were compared to control groups. The compositions of the invention were found to alleviate the inflammatory response, and to reduce recruitment of eosinophils and neutrophils, indicating that they may be useful for treating IL-17- and Th17-mediated conditions such as eosinophilia, neutrophilia and asthma.

Strain
433: *Roseburia hominis*
Study Design
Groups:
1. Negative control group. Treatment with vehicle control (per oral).
2. Treatment with therapeutic bacteria inoculum strain 433 (per oral).
7. Positive control group. Treatment with Dexamethasone (i.p.).
8. Untreated Control Group.
Number of mice per group=5
Day −14 to day 13: Daily administration of vehicle control per oral (Group 1).
Day −14 to day 13: Daily administration of therapeutic bacteria inoculum per oral (Group 2-6).
Day 0, 2, 4, 7, 9, 11 Administration of 15 ug HDM (house dust mite extract—Catalogue number: XPB70D3A25, Lot number: 231897, Greer Laboratories, Lenoir, N.C., USA) in a volume of 30 ul PBS per nasal (Group 1-8).
Day 0, 2, 4, 7, 9, 11 Administration of Dexamethasone (i.p., 3 mg/kg, Sigma-Aldrich, Catalogue number D1159) (Group 7).
Day 14 Sacrifice of all animals for analysis.
Total number of mice=40.
Endpoints and Analysis
On day 14 animals were sacrificed by lethal intraperitoneal injection with pentabarbitol (Streuli Pharma AG, Uznach, Cat: 1170139A) immediately followed by a bronchoalveolar lavage (BAL).
Cells were isolated from the BAL (bronchoalveolar lavage) fluid and differential cell counts performed (200 cell counts/samples).
Material and Methods
Mice. Female 7 week old BALB/c mice were purchased from Charles River Laboratories and randomly allocated to cages totally 5 mice per cage (Ventilated cages sourced from Indulab AG, Gams, Switzerland Cage type: "The Sealsafe™—IVC cage. Product number 1248L). Cages were labeled with study number, group number and experimental starting date. Mice were monitored weekly and acclimatized to facility for 7 days prior to initiation of study (Study Day −14). Animals were 8 weeks old on Study Day −14. Potable water and food were available ad libitum. Cage enrichment was present. Daily care of the animals was performed according to local authorization license number 2283.1 (issued and approved by: Service de la consommation et des affaires vétérinaires du Canton de Vaud). Potable water and food were available ad libitum and refreshed once daily. Cage enrichment was present. Animal welfare regulations were observed as given by official authorities of Switzerland under ordinance 455.163 of the FVO (Federal Veterinary Office) on laboratory animal husbandry, production of genetically modified animals, and methods of animal experimentation.
Culturing of bacteria inoculum. Within a sterile workstation, a cryo-vial of bacteria was thawed by warming in gloved hand and ~0.7 ml of contents injected into a Hungate tube (Cat Number, 1020471, Glasgeratebau Ochs, Bovenden-Lenglern, Germany), containing 8 ml of anaerobic YCFA. Two tubes per strain were usually prepared. The Hungate tubes were then incubated (static) at 37° C. for up to 24-26 hours (for strain 433).
Culturing of vehicle control. A Hungate tube containing 8 ml of anaerobic YCFA was incubated (static) at 37° C. for 16 h.

Figure 2:
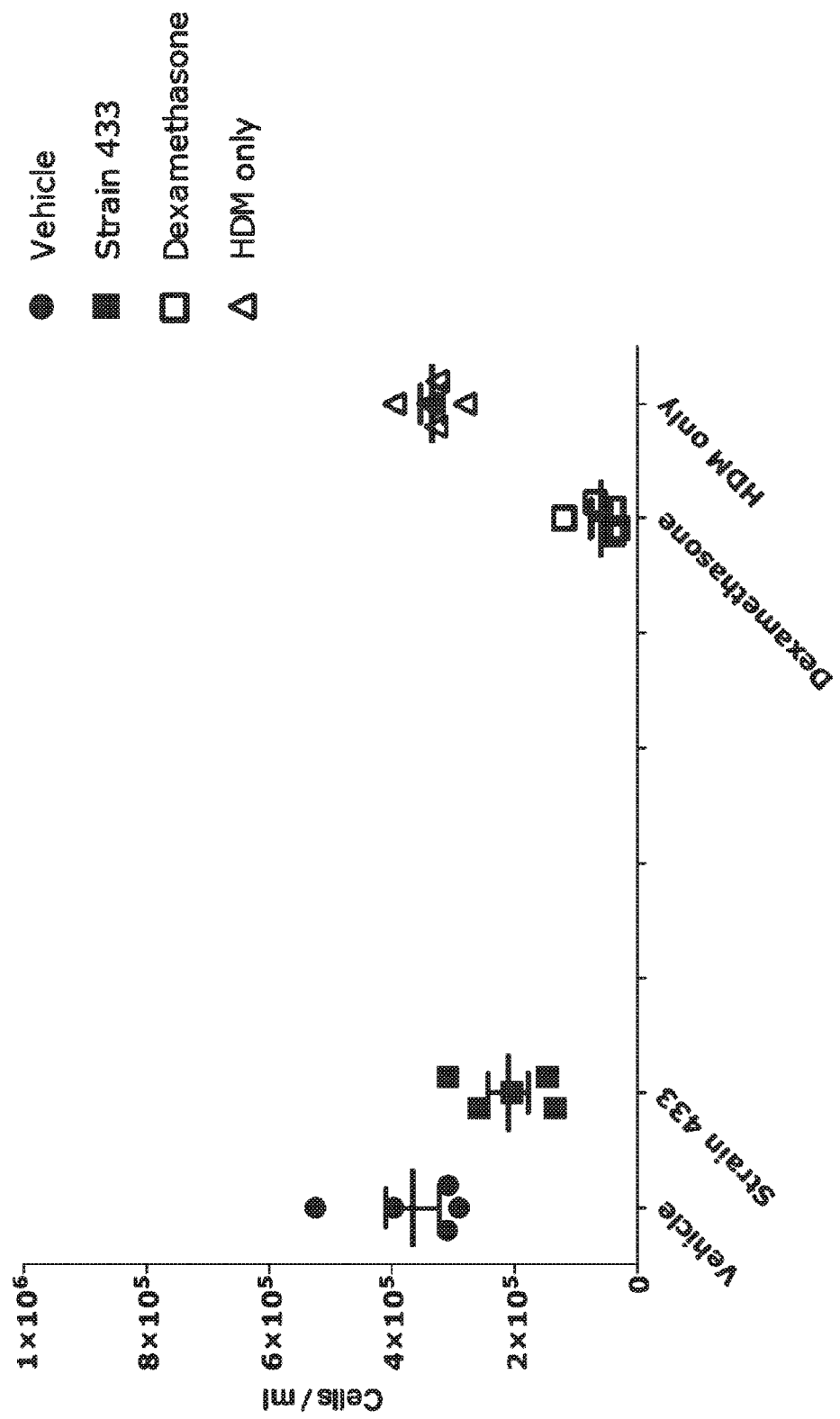
FIG. 2: Mouse model of house dust mite-induced asthma—Total eosinophil count in BALF.
Figure 3:
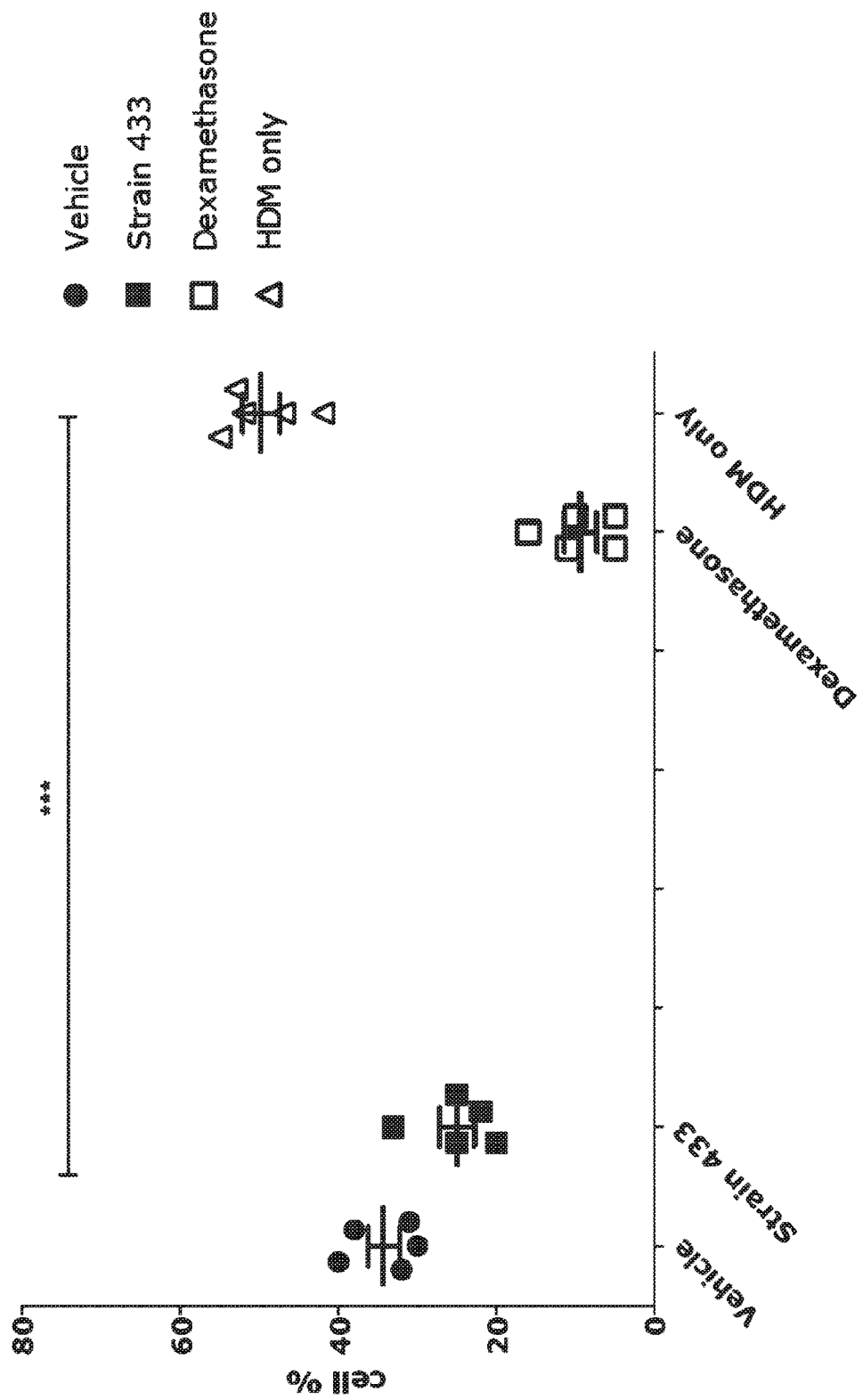
FIG. 3: Mouse model of house dust mite-induced asthma—Proportion of eosinophils in BALF.
Figure 4:
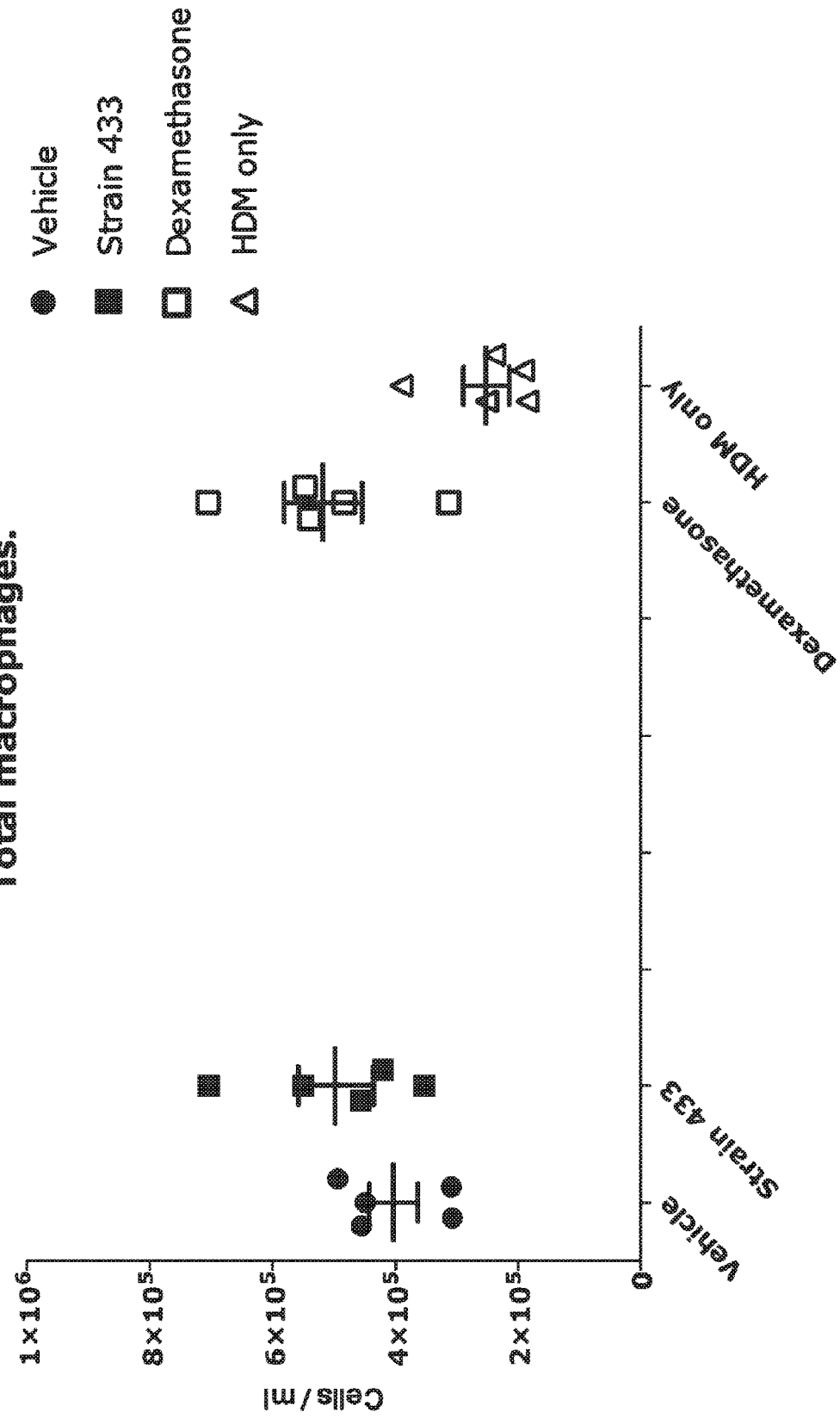
FIG. 4: Mouse model of house dust mite-induced asthma—Total macrophage count in BALF.
Figure 5:
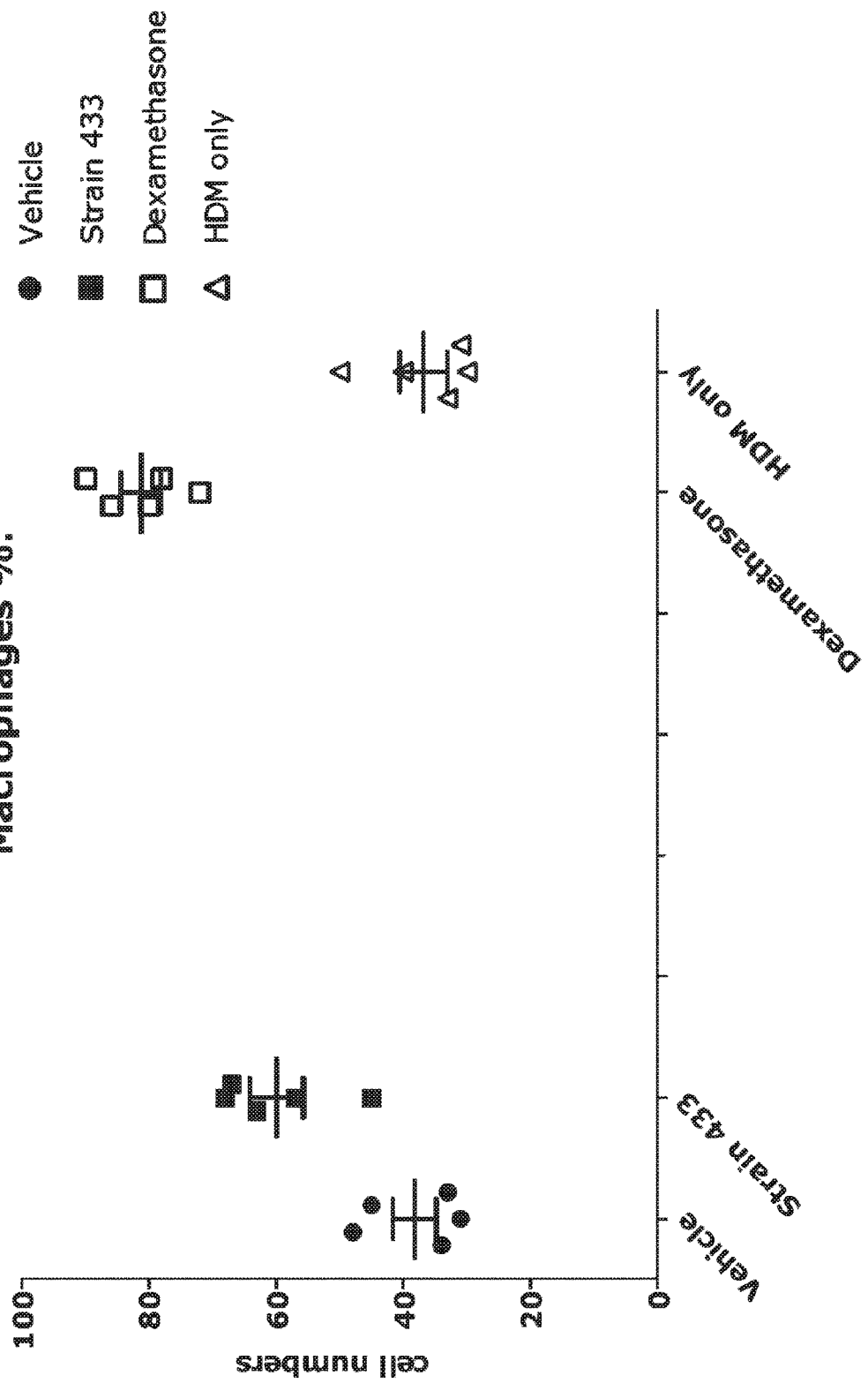
FIG. 5: Mouse model of house dust mite-induced asthma—Proportion of macrophages in BALF.
Figure 6:
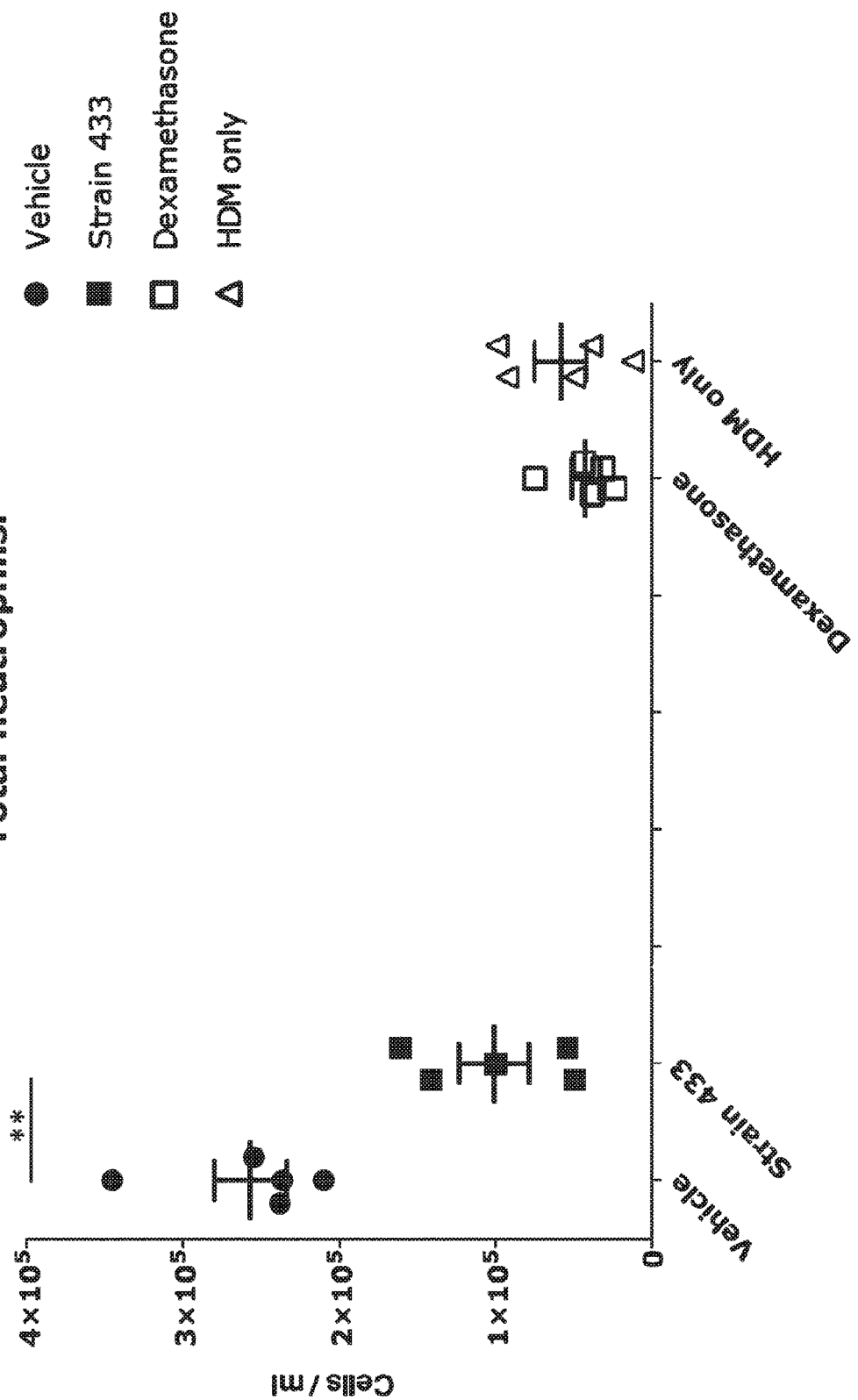
FIG. 6: Mouse model of house dust mite-induced asthma—Total neutrophil count in BALF.
Figure 7:
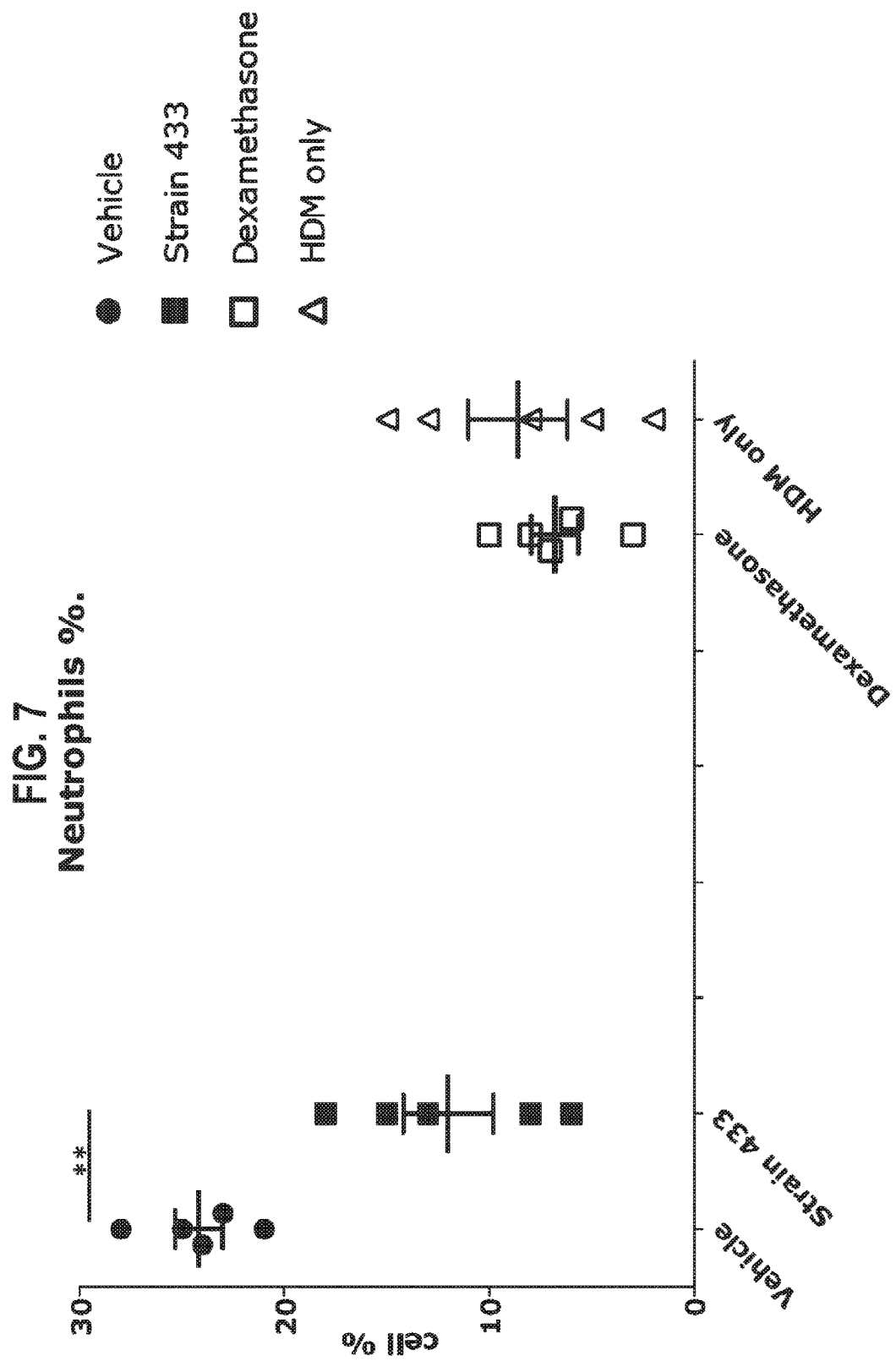
FIG. 7: Mouse model of house dust mite-induced asthma—Proportion of neutrophils in BALF.
Figure 8:
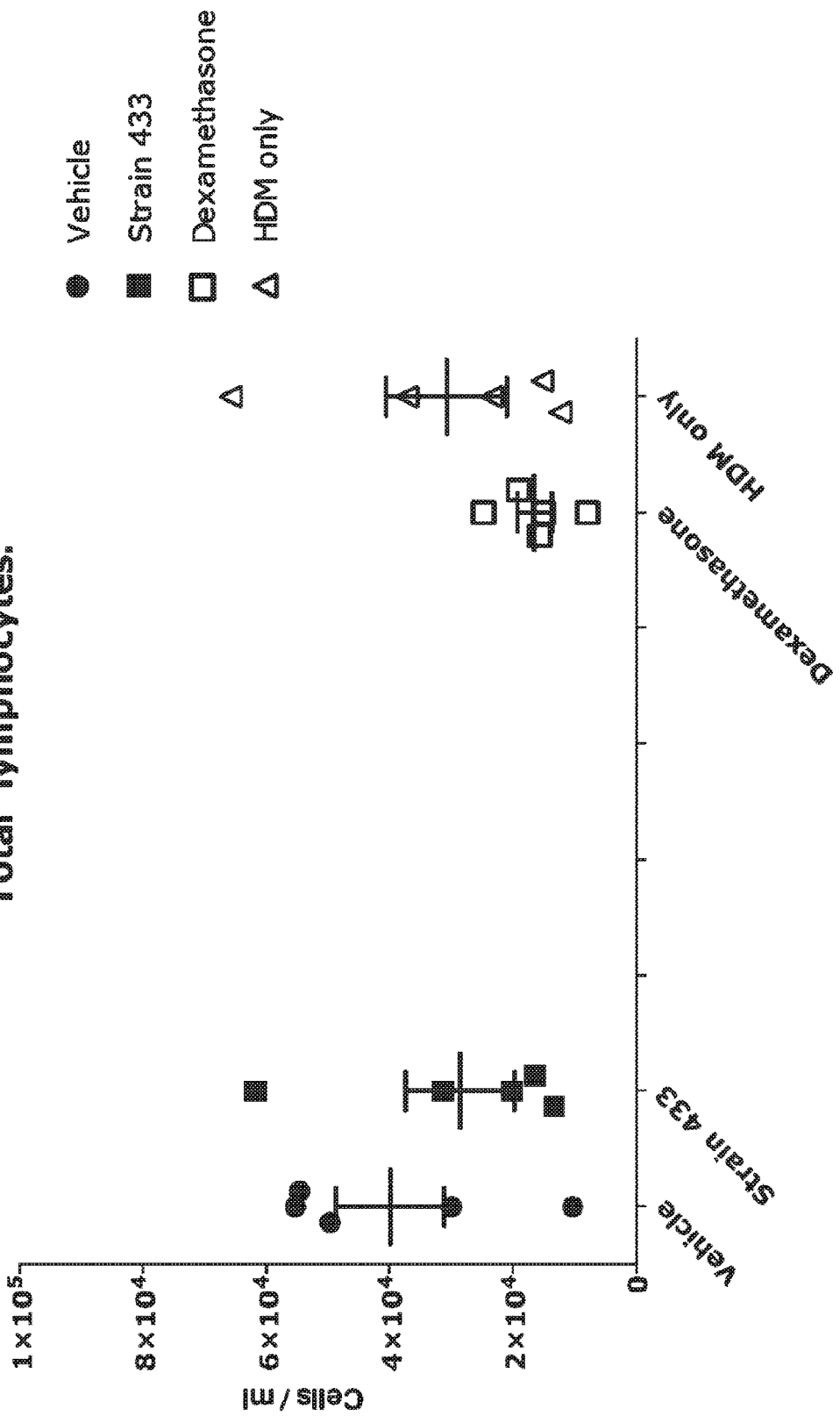
FIG. 8: Mouse model of house dust mite-induced asthma—Total lymphocyte count in BALF.
Figure 9:
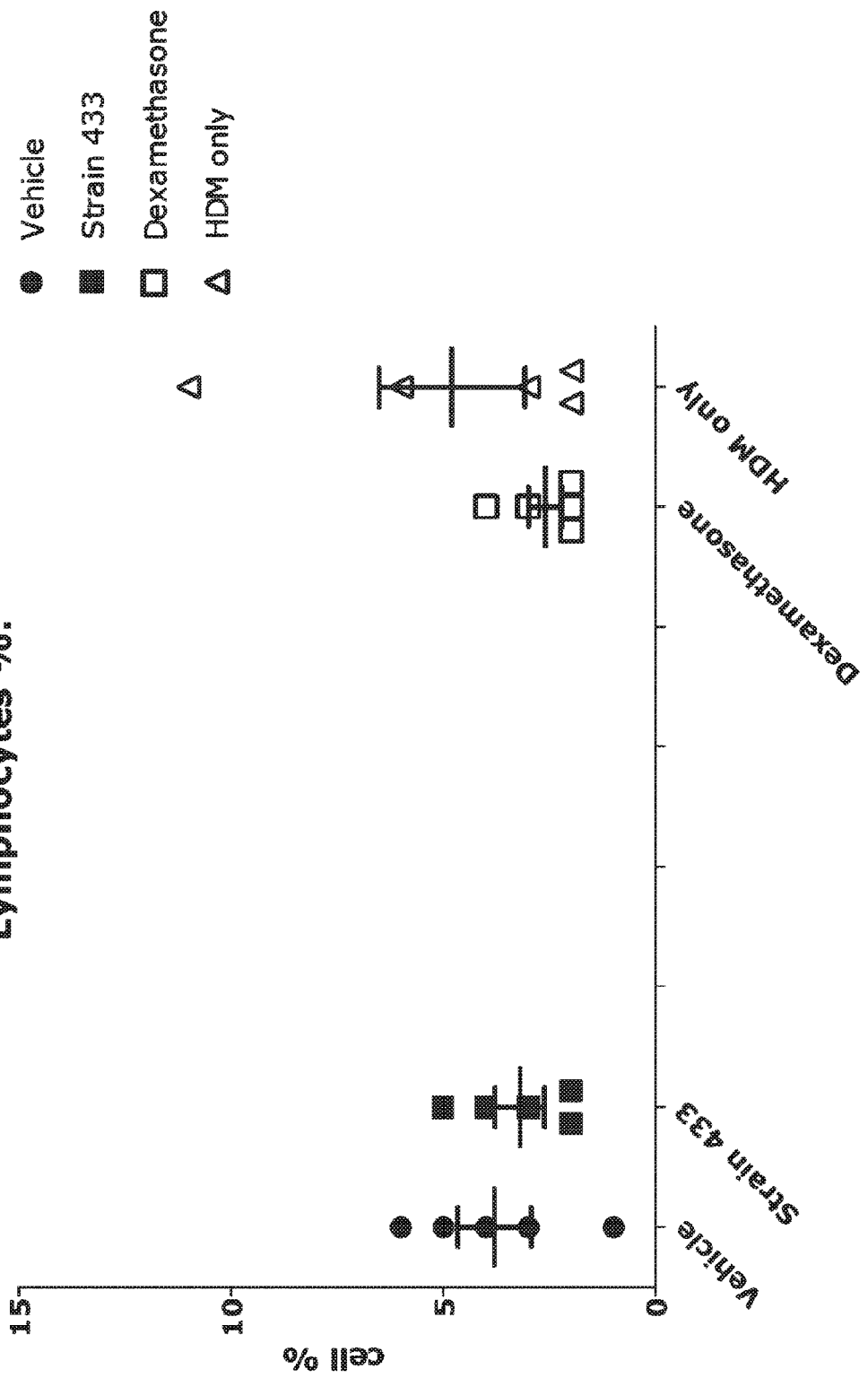
FIG. 9: Mouse model of house dust mite-induced asthma—Proportion of lymphocytes in BALF.
Figure 10:
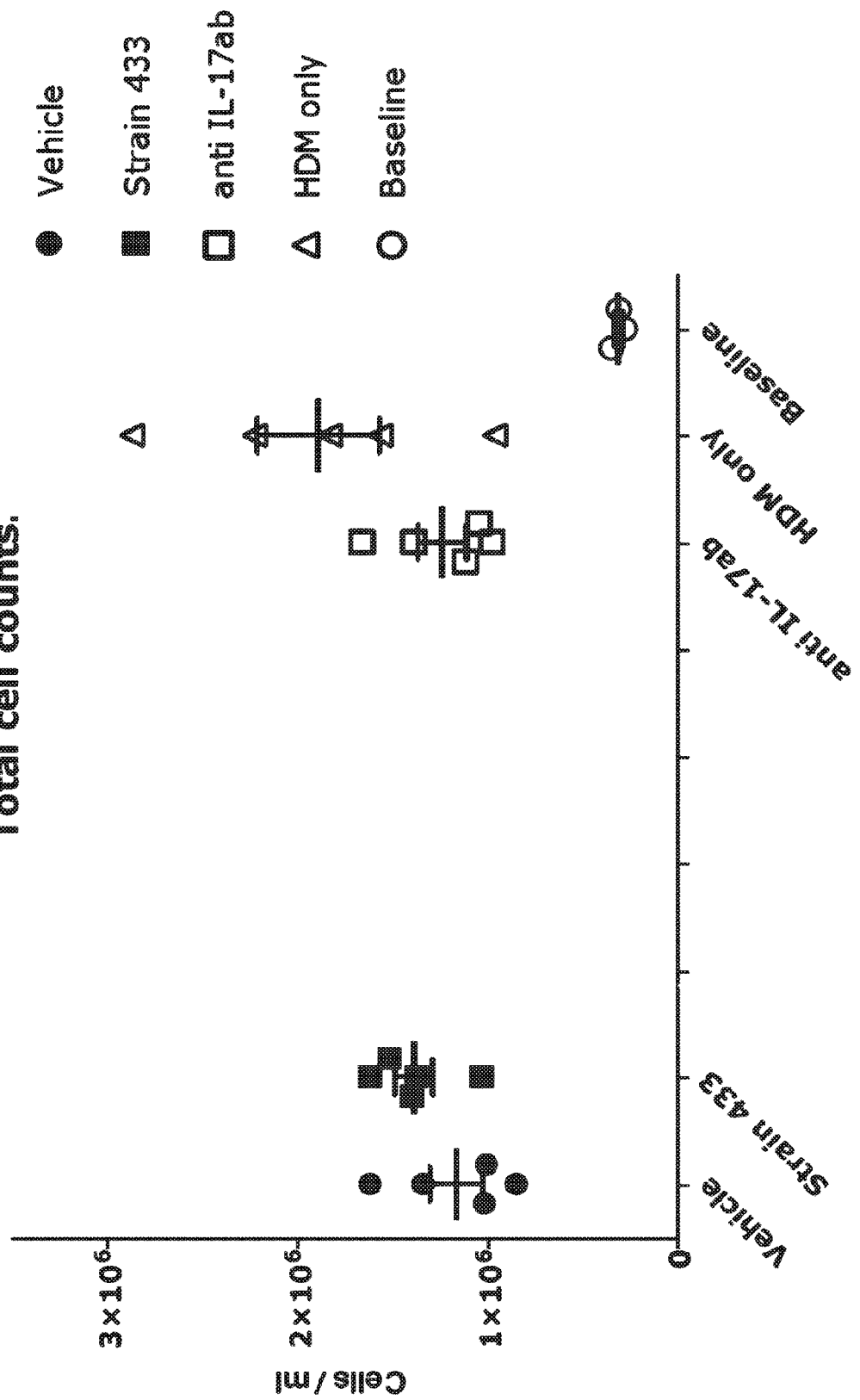
FIG. 10: Mouse model of severe neutrophilic asthma—Total BAL fluid cell counts.
Figure 11:
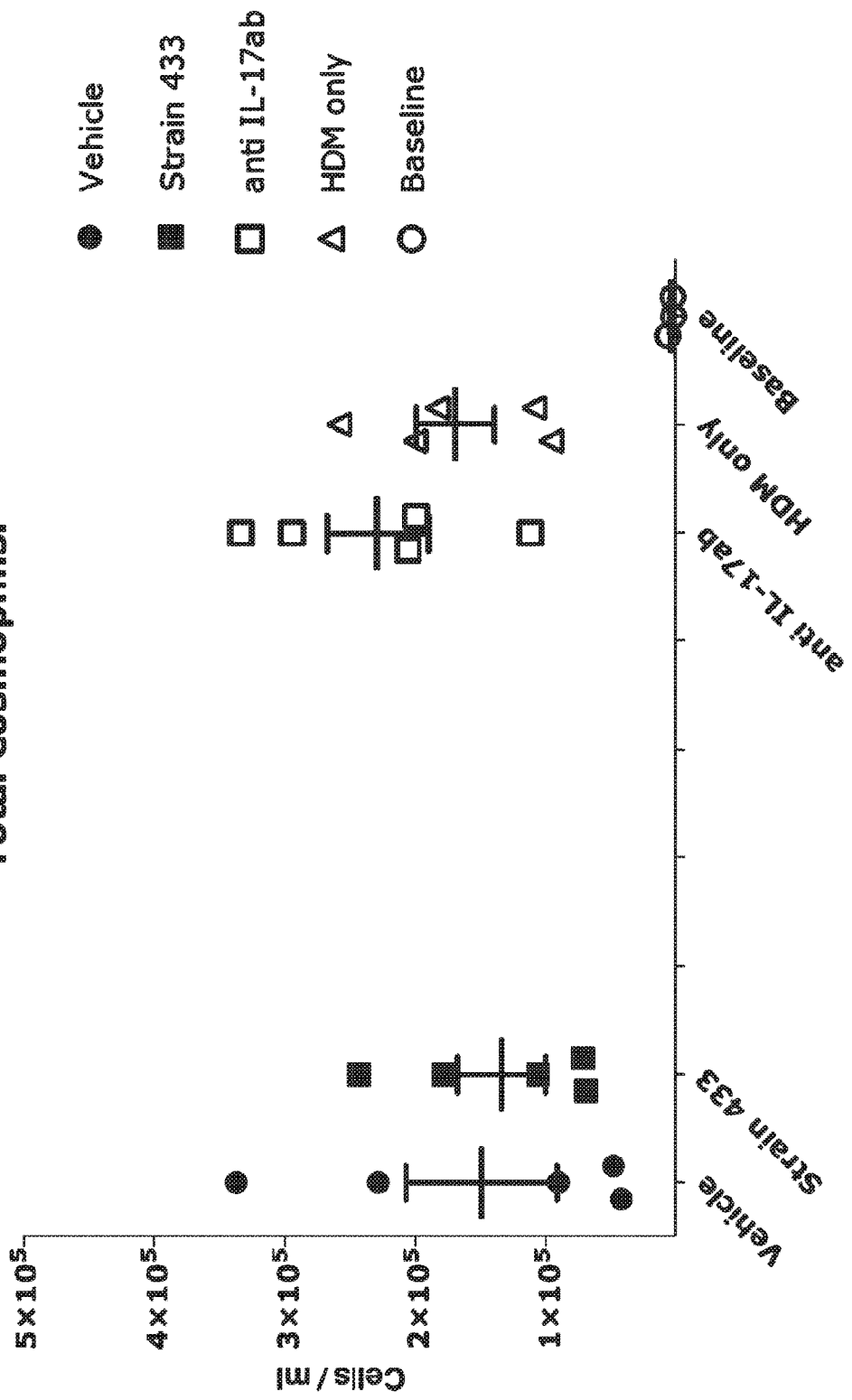
FIG. 11: Mouse model of severe neutrophilic asthma—Total eosinophil count in BALF.
Figure 12:
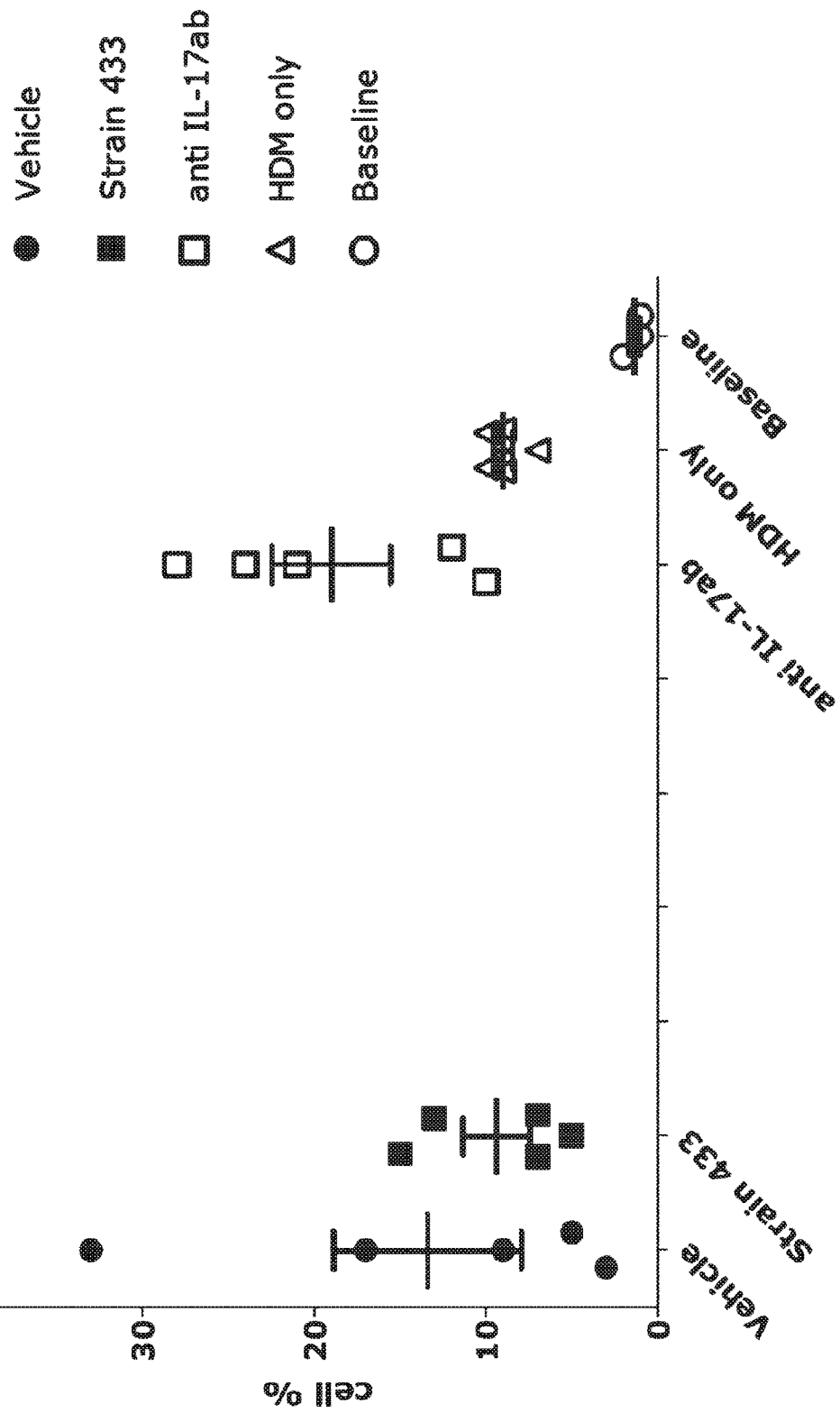
FIG. 12: Mouse model of severe neutrophilic asthma—Proportion of eosinophils in BALF.
Figure 13:
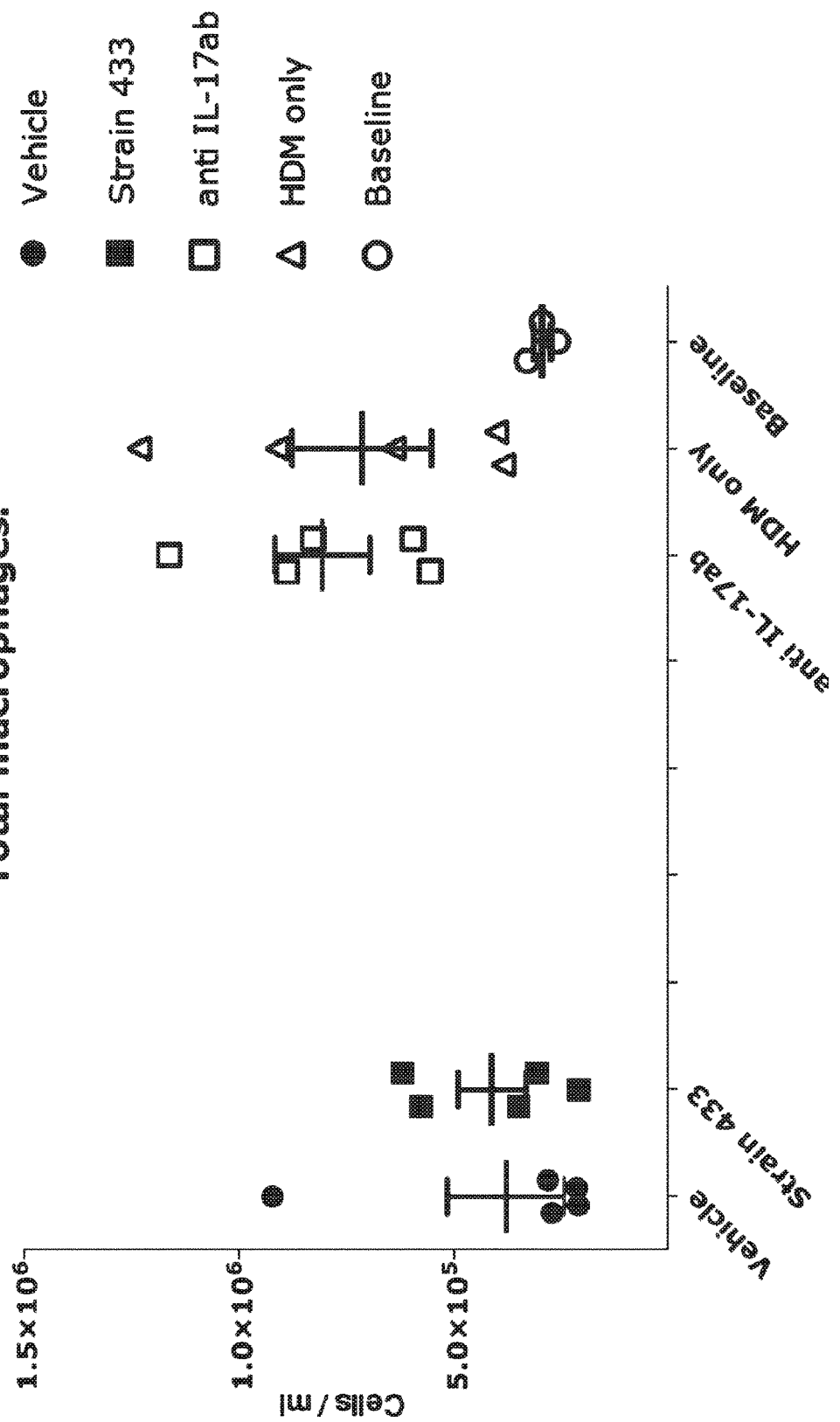
FIG. 13: Mouse model of severe neutrophilic asthma—Total macrophage count in BALF.
Figure 14:
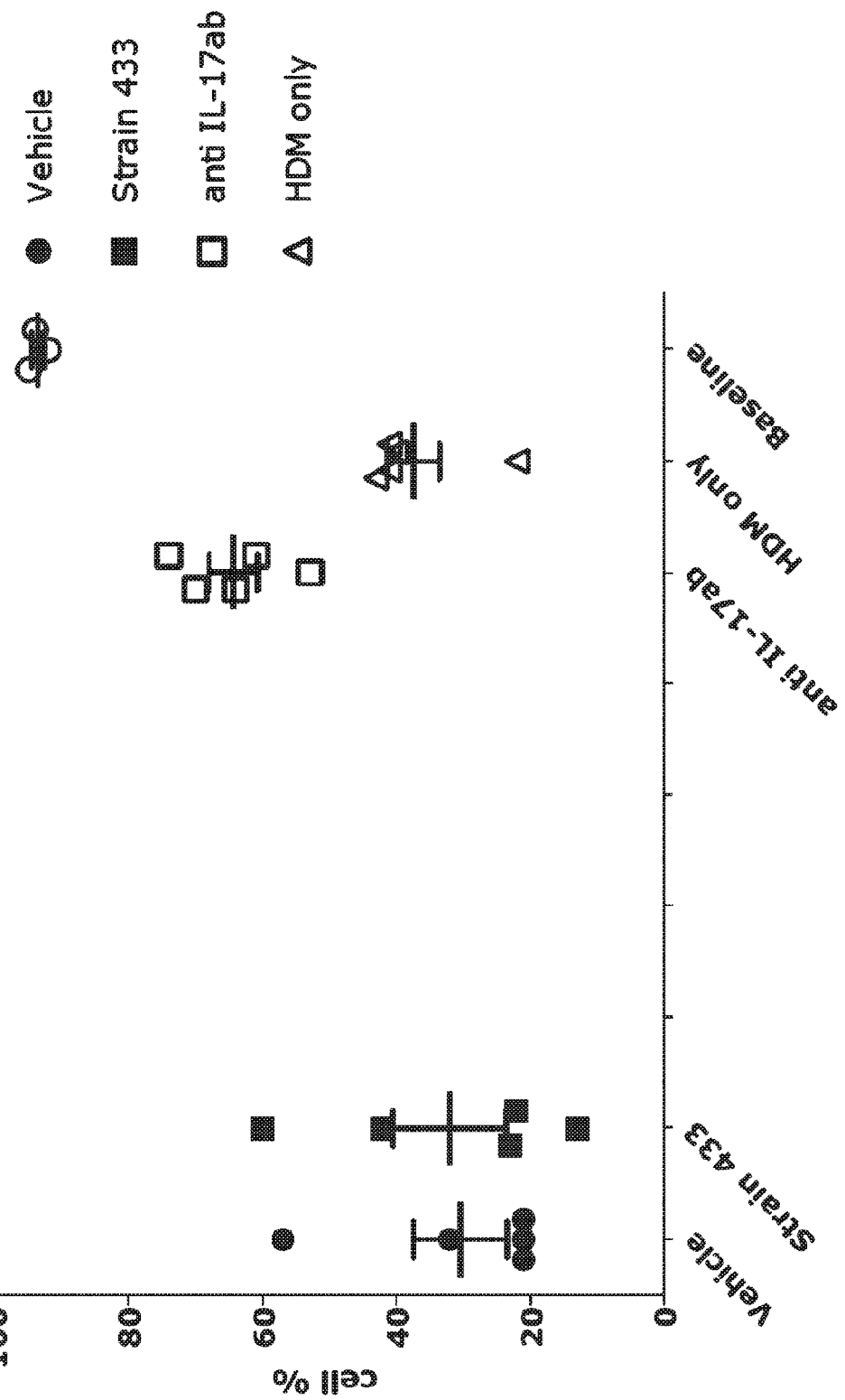
FIG. 14: Mouse model of severe neutrophilic asthma—Proportion of macrophages in BALF.
Figure 15:
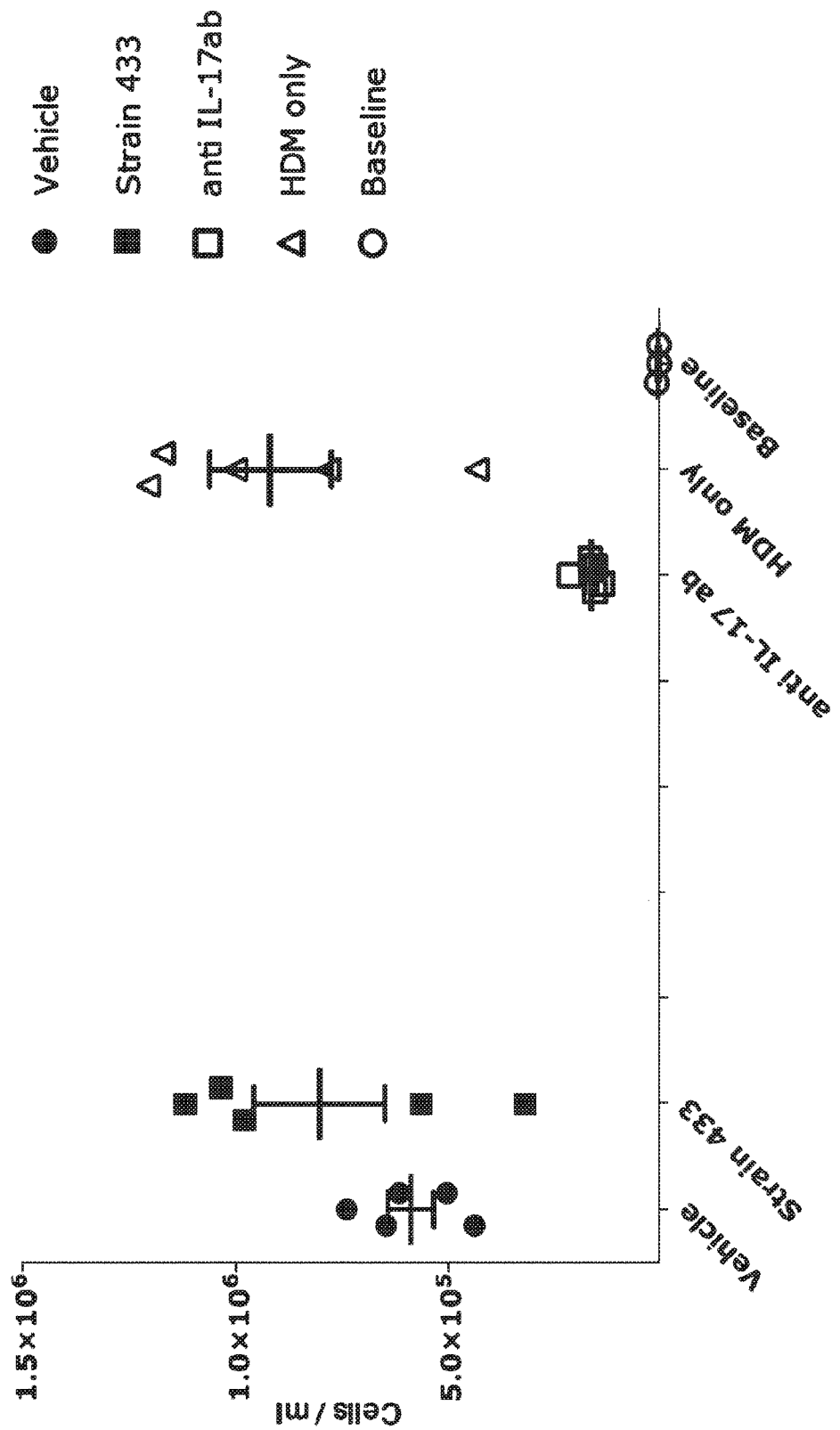
FIG. 15: Mouse model of severe neutrophilic asthma—Total neutrophil count in BALF.
Figure 16:
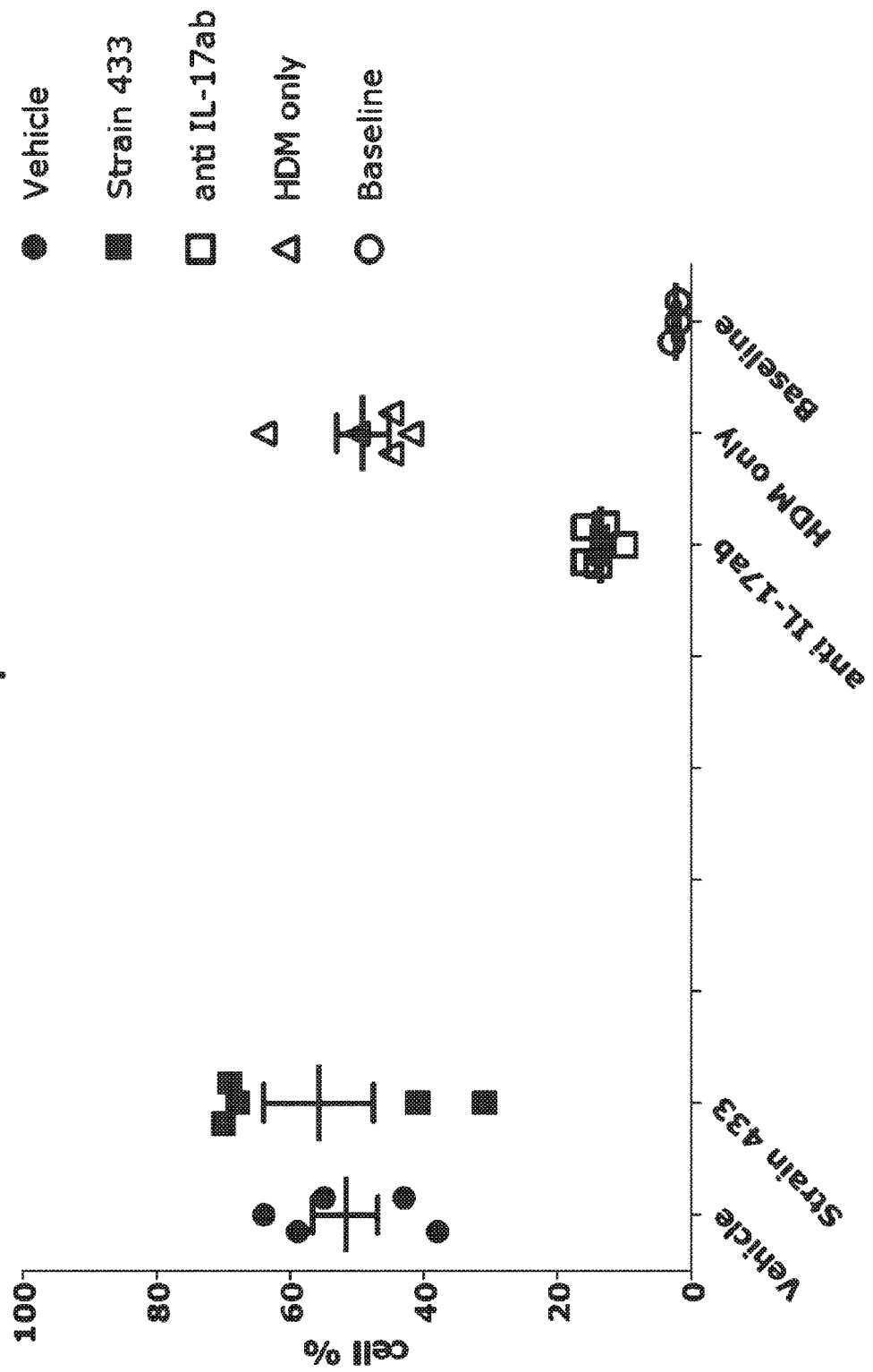
FIG. 16: Mouse model of severe neutrophilic asthma—Proportion of neutrophils in BALF.
Figure 17:
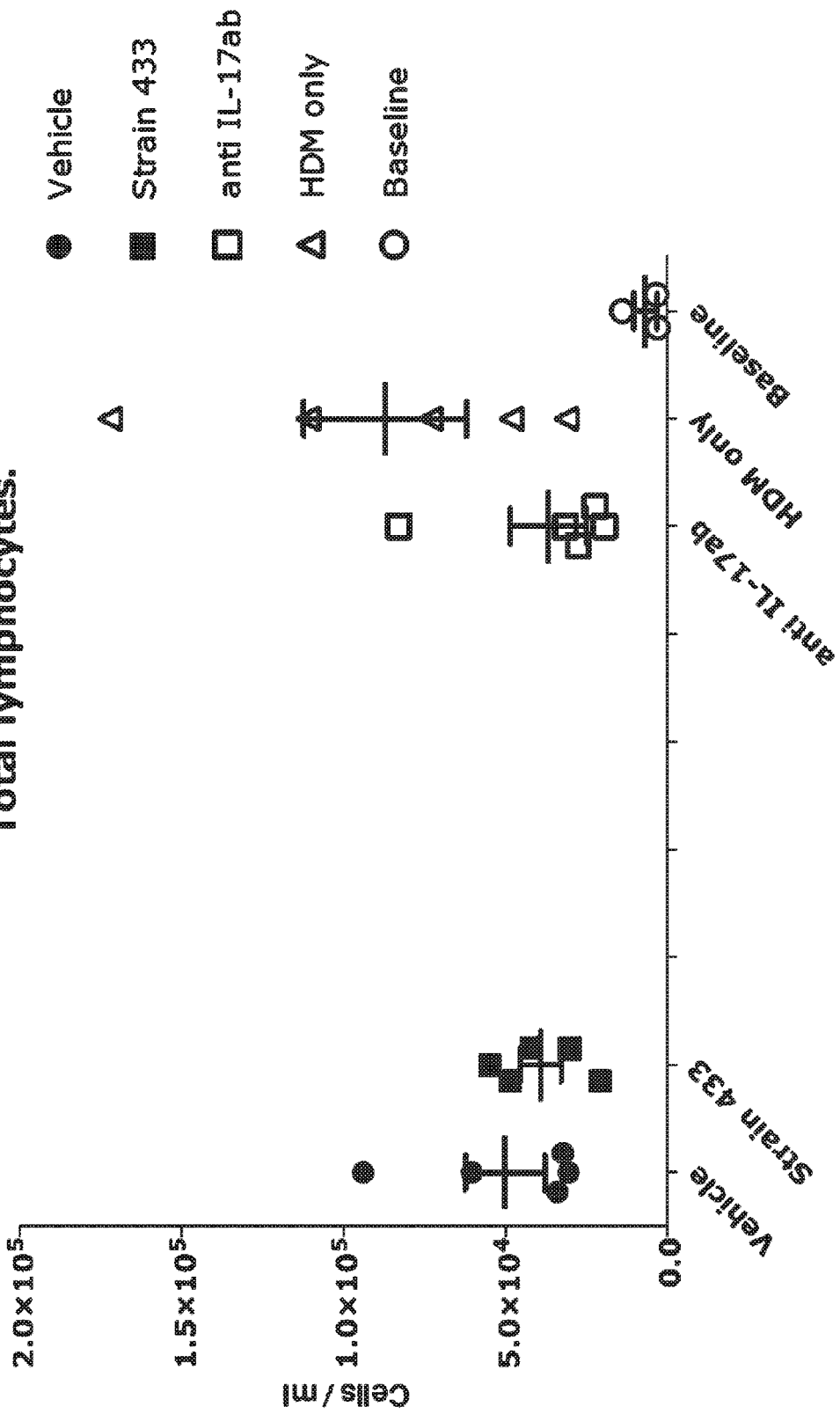
FIG. 17: Mouse model of severe neutrophilic asthma—Total lymphocyte count in BALF.
Figure 18:
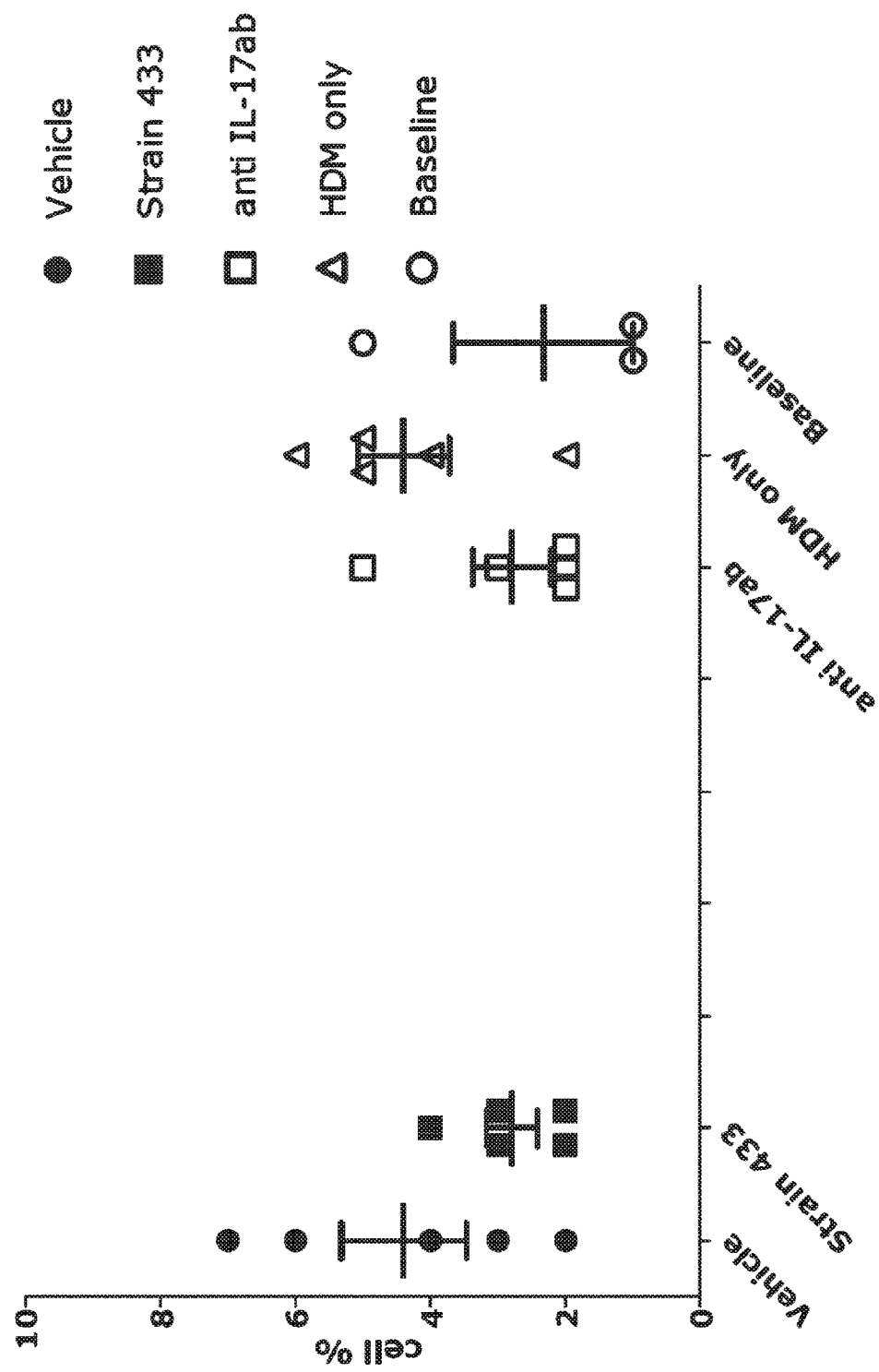
FIG. 18: Mouse model of severe neutrophilic asthma—Proportion of lymphocytes in BALF.

Administration of bacteria inoculum or vehicle control. 400 ul of cultured bacteria inoculum or vehicle control were administered per day per oral gavage.
Intranasal sensitization. Mice were anesthetized by i.p. injection with 9.75 mg xylasol and 48.75 mg ketasol per kg (Dr. E. Graeub AG, Bern, Switzerland) and administered with 15 ug of HDM (Catalogue number: XPB70D3A25, Lot number: 231897, Greer Laboratories, Lenoir, N.C., USA) in a volume of 30 ul PBS per nasal.
Preparation and administration of positive control compound dexamethasone. Dexamethasone 21-phosphate disodium salt (Sigma-Aldrich, Catalogue number D1159, Lot No SLBD.1030V) was solved in $H_2O$ and administered to the animals in a dose of 3 mg/kg in a volume of 200 ul per oral at days indicated in study protocol above.
Terminal procedure. On day 14 animals were sacrificed by lethal i.p. injection with pentabarbitol (Streuli Pharma AG, Uznach, Cat: 1170139A) immediately followed by bronchoalveolar lavage (BAL) in 500 ul of saline.
Measurement of cellular infiltrates into BAL. Cells were isolated from the BAL fluid and differential cell counts were performed based upon standard morphological and cytochemical criteria.
Graphs and statistical analysis. All graphs were generated with Graphpad Prism Version 6 and a one-way ANOVA was applied. Results from the statistical analysis were provided with the individual data tables. Error bars represent Standard Error of the Mean (SEM).
Results and Analysis
The results of the experiments are shown in FIGS. 1-9.
No morbidity or mortality was noted in the mice treated with the bacteria or the vehicle. The two controls, vehicle treatment (negative control) and the dexamethasone treatment (positive control) behaved as expected, with impaired eosinophilia and neutrophilia noted following dexamethasone treatment.
Strain 433 was efficacious in alleviating the magnitude of the allergic inflammatory response. As shown in FIGS. 2 and 3, administration of strain 433 reduced total eosinophils and the proportion of eosinophils in BAL, which indicates reduced eosinophilia. In addition, administration of strain 433 resulted in a statistically significant reduction in total neutrophils and the proportion of neutrophils in BAL relative to the vehicle-only control, as shown in FIGS. 6 and 7.

Example 2

Efficacy of Bacterial Inocula in a Mouse Model of Severe Neutrophilic Asthma

Summary
Mice were administered with compositions comprising bacterial strains according to the invention and were subsequently sensitised with subcutaneous administrations of house dust mite (HDM) extract and challenged with an intranasal administration of HDM in order to model the inflammatory response of severe neutrophilic asthma. The magnitude and characteristics of the inflammatory response exhibited by mice treated with compositions of the invention were compared to control groups. The compositions of the invention were found to alleviate the inflammatory response, and in particular to reduce recruitment of neutrophils, in a manner comparable to the positive control comprising administrations of anti-IL-17 antibodies. The data therefore indicate that the compositions of the invention may be useful for treating IL-17- and Th17-mediated conditions such as neutrophilia and asthma.

Strain
433: *Roseburia hominis*
Study Design
Groups:
1. Negative control group. Treatment with vehicle control (per oral).
2. Treatment with therapeutic bacteria inoculum strain 433 (per oral).
7. Positive control group. Treatment anti-IL-17 (i.p.).
8. Untreated Control Group.
9: Healthy mice (baseline).
Number of mice per group (Group 1-8)=5
Day −14 to day 17: Daily administration of vehicle control per oral (Group 1).
Day −14 to day 17: Daily administration of therapeutic bacteria inoculum per oral (Group 2-6).
Day 0: Sensitization with HDM in CFA (s.c.) (Group 1-8).
Day 7: Sensitization with HDM in CFA (s.c.) (Group 1-8).
Day 13, 15, 17: Administration of anti IL-17 neutralizing antibody per i.p. (Group 7).
Day 14, 15, 16, 17: Challenge with HDM in 30 ul PBS per nasal (Group 1-8).
Day 18: Sacrifice of all animals for analysis.
Endpoints and Analysis:
On day 14 animals were sacrificed by lethal intraperitoneal injection with pentabarbitol (Streuli Pharma AG, Uznach, Cat: 1170139A) immediately followed by a bronchoalveolar lavage (BAL). Cells were isolated from the BAL fluid and differential cell counts performed (200 cell counts/samples).
Material and Methods.
Mice. Female 7 week old C57BL/6 mice were purchased from Charles River Laboratories and randomly allocated to cages totally 5 mice per cage (Ventilated cages sourced from Indulab AG, Gams, Switzerland Cage type: "The Sealsafe™—IVC cage. Product number 1248L). Cages were labelled with study number, group number and experimental starting date. Mice were monitored weekly and acclimatized to facility for 7 days prior to initiation of study (Study Day −14). Animals were 8 weeks old on Study Day −14. Potable water and food were available ad libitum. Cage enrichment was present. Daily care of the animals was performed according to local authorization license number 2283.1 (issued and approved by: Service de la consommation et des affaires vétérinaires du Canton de Vaud). Potable water and food were available ad libitum and refreshed once daily. Cage enrichment was present. Animal welfare regulations were observed as given by official authorities of Switzerland under ordinance 455.163 of the FVO (Federal Veterinary Office) on laboratory animal husbandry, production of genetically modified animals, and methods of animal experimentation.

Culturing of bacteria inoculum. Within a sterile workstation, a cryo-vial of bacteria was thawed by warming in gloved hand and ~0.7 ml of contents injected into a Hungate tube (Cat Number, 1020471, Glasgeratebau Ochs, Bovenden-Lenglern, Germany), containing 8 ml of anaerobic YCFA. Two tubes per strain were usually prepared. The Hungate tubes were then incubated (static) at 37° C. for up to 24-26 hours (for strain 433).

Culturing of vehicle control. A Hungate tube containing 8 ml of anaerobic YCFA was incubated (static) at 37° C. for 16 h.

Administration of bacteria inoculum or vehicle control. 400 ul of cultured bacteria inoculum or vehicle control were administered per day per oral gavage.

HDM sensitization. 50 µg of HDM (Catalogue number: XPB70D3A25, Lot number: 231897, Greer Laboratories, Lenoir, N.C., USA) in PBS was emulsified in equal volume of complete Freund's adjuvant (CFA Chondrex Inc. Washington, USA) and administered subcutaneously in a volume of 200 µl, twice over two weeks on opposite flanks. A week after the second immunization, mice were anesthetized by i.p. injection with 9.75 mg xylasol and 48.75 mg ketasol per kg (Dr. E. Graeub AG, Bern, Switzerland) and then given intranasal challenges of 15 µg of HDM in a volume of 30 ul PBS on 4 consecutive days. Analysis was performed one day after the final challenge.

Preparation and administration of positive control compound anti mouse IL-17 antibody. Anti-IL-17 neutralizing antibody was sourced from Bio X Cell and was stored at 4° C. (Clone 17F3, Cat. Number BE0173, Bio X Cell) and administered per i.p. at a dose of 12.5 mg/kg at days indicated in study protocol above.

Terminal procedure. On day 18 animals were sacrificed by lethal i.p. injection with pentabarbitol (Streuli Pharma AG, Uznach, Cat: 1170139A) immediately followed by bronchoalveolar lavage (BAL) in 500 ul of saline.

Measurement of cellular infiltrates into BAL. Cells were isolated from the BAL fluid and differential cell counts were performed based upon standard morphological and cytochemical criteria.

Graphs and statistical analysis. All graphs were generated with Graphpad Prism Version 6 and a one-way ANOVA was applied. Results from the statistical analysis are provided with the individual data tables. Error bars represent Standard Error of the Mean (SEM).

Results and Analysis

The results of the experiment are shown in FIGS. 10-18.

No morbidity or mortality was noted in the mice treated with the bacteria or the vehicle. As shown in FIGS. 11, 12, 15 and 16, certain mice treated with strain 433 exhibited reduced eosinophilia and neutrophilia.

Example 3

Efficacy of Bacterial Inocula to Treat Arthritis in a Type II Collagen-Induced Arthritis Mouse Model Materials and Methods
Strain
433: *Roseburia hominis*
Bacterial Cultures Bacterial cultures were grown up for administration in an anaerobic workstation (Don Whitley Scientific).

Bacterial strain #433 was grown using glycerol stocks. The glycerol stocks were stored at −80° C. Three times per week, glycerol stocks were thawed at room temperature and streaked on YCFA plates. A new glycerol aliquot was used on each occasion. Bacteria were allowed to grow on a given plate for up to 72 hours.

Solutions to be administered to the animals were prepared twice daily with an eight hour interval for morning (AM) and afternoon (PM) treatments. A bacterial colony was picked from the streaked plate and transferred into a tube containing YCFA media. Bacterial strain #433 was allowed to grow for 24 hours before AM administrations. Bacteria were sub-cultured at 1% into YCFA media for PM administrations. OD values were recorded for each strain after morning and afternoon treatment preparations.

Type II Collagen-Induced Arthritis Mouse Model

Adult male DBA/1 mice were randomly allocated to experimental groups and allowed to acclimatise for two weeks. On Day 0, animals were administered by subcutaneous injection with 100 microliters of an emulsion containing 100 micrograms of type II collagen (CII) in incomplete's Freund's adjuvant supplemented with 4 mg/ml *Mycobacterium tuberculosis* H37Ra. On Day 21, animals were administered by subcutaneous injection with a booster emulsion containing 100 µg of type II collagen in incomplete Freund's adjuvant.

Treatments were given according to the administration schedule below. From Day −14 until the end of the experiment on Day 45, animals were weighed three times per week. From Day 21 until the end of the experiment, animals were scored three times per week for clinical signs of arthritis to include swelling of the hind- and front paws, radio-carpal (wrist) joints and tibio-tarsal (ankle) joints.

On Day 45 mice were culled and terminal blood samples were taken for cytokine analysis.

On Day −14, Day 0 and Day 45, faecal samples were collected for microbiological analysis, immediately snap-frozen and stored at −80° C.

The collagen-induced arthritis (CIA) mouse model is a well-established mouse model for rheumatoid arthritis [53]. Immunisation with CII causes a pathogenesis that includes several important pathological features of rheumatoid arthritis, including synovial hyperplasia, mononuclear cell infiltration and cartilage degradation. Significantly, the development of CIA is mediated by Th17 cells through secretion of IL-17A [54]. The immune response underlying the arthritis model is enhanced by the use of Freund's adjuvant supplemented with *Mycobacterium tuberculosis*.

On Day 21, spleens were collected from three satellite animals in each group. Cells were cultured for 72 hours in the presence or absence of type II collagen. Cytokines, including TNF-α, IL-6, IFN-γ, IL-4, IL-10 and IL-17, were quantified in the culture supernatants and in terminal serum by Luminex. Cell proliferation was quantified using a tritiated thymidine incorporation method.

Treatment Groups and Dosages

All Groups were n=15 (n=12 for the main study group and n=3 for satellite groups)

The vehicle used for the biotherapeutics was Yeast extract-Casitone-Fatty Acids (YCFA) medium.

| Group | Dose | Administration Route | Regimen | Disease Induction |
|---|---|---|---|---|
| 1 Vehicle | 5 ml/kg | PO | BID: Day-14-End | Day 0: Collagen/CFA, once, SC Day 21: Collagen/IFA, once, SC |
| 6 Biotherapeutic #433 | 5 ml/kg | | | |

PO: oral gavage, SC: subcutaneous injection, BID: twice a day, CFA: complete Freund's adjuvant.

Bodyweights

From Day −14 until the end of the experiment, animals were weighed three times per week. Data were graphed (Mean±SEM).

Non-Specific Clinical Observations

From Day −14 until the end of the experiment, animals were checked daily for non-specific clinical signs to include abnormal posture (hunched), abnormal coat condition (pilo-erection) and abnormal activity levels (reduced or increased activity).

Clinical Observations

From Day 21 until the end of the experiment on Day 45, animals were scored three times per week for clinical signs of arthritis to include swelling of the hind- and front paws, radio-carpal (wrist) joints and tibio-tarsal (ankle) joints. Each limb was scored using the following scale: (0) normal, (1) slight swelling, (2) mild swelling, (3) moderate swelling and (4) severe swelling. A clinical score was calculated by adding each limb score. The maximum possible clinical score for an animal was (16). Animals with a score equal to (12) on two consecutive occasions and animals with a score greater than (12) on any one occasion were culled. Data were graphed (Mean±SEM).

Cell Proliferation Analysis

On Day 21, three satellite animals per group were culled and spleens were dissected out. Spleen cells were cultured for 72 hours in presence or absence of type II Collagen. After 72 hours, cells were pulsed overnight in the presence of tritiated thymidine. Cell proliferation was quantified by measuring thymidine incorporation. Data were graphed (Mean±SEM). Supernatants were taken and tested for the presence of key cytokines.

Cytokine Analysis

Terminal supernatants from the spleen cell cultures were tested in order to quantitate TNF-α, IL-6, IFN-γ, IL-4, IL-10 and IL-17 by Luminex. Data were graphed (Mean±SEM).

Microbiological Analysis

On Day −14, Day 0 and Day 45, faecal samples were collected from each animal, immediately snap-frozen, and stored at −80° C. Caeca (including content) were immediately snap-frozen and stored at −80° C. A bacterial identification test was performed daily by plating the bacteria.

Histopathology

At the end of the experiment, hind paws were stored in tissue fixative. Samples were transferred into decalcification solution. Tissue samples were processed, sectioned and stained with Haematoxylin & Eosin. Sections were scored by a qualified histopathologist, blind to the experimental design, for signs of arthritis to include inflammation, articular cartilage damage and damage to the underlying metaphyseal bone. A detailed scoring system was used (see below). Data were graphed (Mean±SEM). Raw and analysed data were provided as well as representative pictures.

TABLE 1

Histopathology Scoring System

| Grade | Description |
|---|---|
| | Inflammation |
| 0 | Normal joint |
| 1 | Mild synovial hyperplasia with inflammation dominated by neutrophils. Low numbers of neutrophils and macrophages in joint space. |
| 2 | Synovial hyperplasia with moderate to marked inflammation involving both neutrophils and macrophages. Neutrophils and macrophages in joint space; may be some necrotic tissue debris. |
| 3 | Synovial hyperplasia with marked inflammation involving both neutrophils and macrophages. Loss of synoviocyte lining. Inflammation may extend from synovium to surrounding tissue including muscle. Numerous neutrophils and macrophages in joint space, together with significant necrotic tissue debris. |
| | Articular cartilage damage |
| 0 | Normal joint |
| 1 | Articular cartilage shows only mild degenerative change. Early pannus formation may be present peripherally. |
| 2 | Articular cartilage shows moderate degenerative change and focal loss. Pannus formation is present focally. |

TABLE 1-continued

Histopathology Scoring System

| Grade | Description |
|---|---|
| 3 | Significant disruption and loss of articular cartilage with extensive pannus formation. |

Damage to the underlying metaphyseal bone

| | |
|---|---|
| 0 | Normal joint |
| 1 | No change to underlying metaphyseal bone. |
| 2 | May be focal necrosis or fibrosis of metaphyseal bone. |
| 3 | Disruption or collapse of metaphyseal bone. Extensive inflammation, necrosis or fibrosis extending to medullary space of the metaphysis. |

Results and Analysis

Survival and Non-Specific Clinical Observations

Some animals were culled prior to the scheduled end of the study due to the severity of the clinical signs of arthritis or due to the severity of the non-specific clinical observations.

Two animals were culled or found dead during the pre-treatment period (Day −14 to Day 0): one animal in Group 1 (vehicle-treated, animal arrived from supplier with broken leg and was culled) and one animal in Group 6 (biotherapeutic #433-treated).

Ten animals were culled due to the severity of the clinical signs of arthritis: five animals in Group 1 (vehicle-treated) and five animals in Group 6 (biotherapeutic #433-treated).

Four animals were culled due to the severity of the non-specific clinical signs including abnormal posture (hunched), abnormal coat condition (piloerection), abnormal activity levels (reduced activity): three animals in Group 1 (vehicle-treated) and one animal in Group 6 (biotherapeutic #433-treated).

Bodyweights

Bodyweight data recorded from Day −14 until Day 0 and expressed as a percentage of the initial (Day −14) bodyweights were analysed by two-way ANOVA followed by Dunnett's post-test for multiple comparisons with Day −14 then for multiple comparison with the vehicle-treated group. The data are presented in FIG. 19. Data from animals culled prior to the scheduled end of the experiment were excluded from the analyses.

When compared to Day −14, twice daily administrations by oral gavage induced a significant bodyweight loss in the vehicle-treated group on Day −9 and Day −7.

Bodyweight data recorded from Day 0 until Day 28 and expressed as a percentage of the initial (Day 0) bodyweights were analysed by two-way ANOVA followed by Dunnett's post-test for multiple comparisons with Day 0 in the Vehicle group then for multiple comparison with the vehicle-treated group. The data are presented in FIG. 20. Data from animals culled prior to the scheduled end of the experiment and from Satellite animals were excluded from the analyses. Day 28, Day 35 and Day 42 data were further analysed by one-way ANOVA followed by Dunnett's post-test for multiple comparisons to the vehicle-treated group.

The onset of clinical signs of arthritis was associated with a significant bodyweight loss on Day 26 and Day 28 ($p<0.0001$) when compared to Day 0 in the vehicle-treated group.

Clinical Observations

Clinical score data were analysed by two-way ANOVA followed by Dunnett's post-test for multiple comparisons between days in the vehicle-treated group then for multiple comparisons between experimental groups and the vehicle-treated group each day. The data are presented in FIG. 21. Data recorded from animals culled prior to the end of the experiment were excluded from the analysis. When animals were culled due to the severity of the clinical signs of arthritis, the last recorded score was reported for the following days and used in the statistical analyses.

A significant increase of the clinical scores was observed in the vehicle-treated group from Day 28 until Day 45 ($p<0.0001$) when compared to Day 21.

Biotherapeutic #433 induced a reduction of the clinical scores when compared to the vehicle-treated group from Day 28 until Day 45, although the difference was non-significant.

Cell Proliferation Analysis

To validate the assay, splenocytes were cultured in the presence of soluble anti-CD3 and anti-CD28 (anti-CD3/CD28) as positive control stimuli to confirm the proliferative potential of the cells.

Strong proliferative responses to anti-CD3/CD28 were seen in all experimental groups, showing cells were healthy, viable and able to respond to activation signals.

Figure 22:
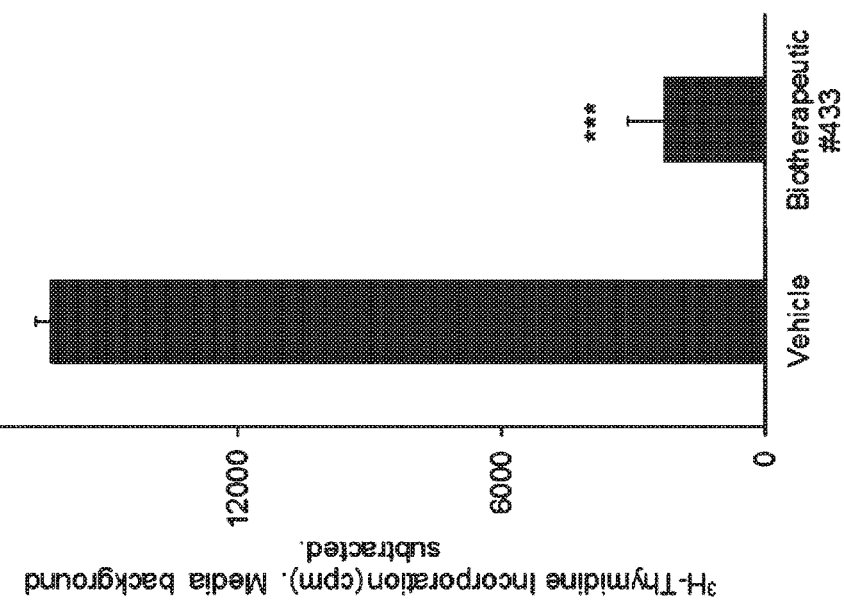
FIG. 22: Mouse model of rheumatoid arthritis—Splenocyte proliferative response to Collagen II. Media background subtracted [CII-stimulated—media background] counts per minute based on 3H-TdR incorporation. All data are presented as Mean±SEM. *** $p<0.001$ compared to Vehicle group.

To test the proliferative response in presence of Collagen II (CII), splenocytes were cultured in the presence of CII at 50 μg/ml. Splenocyte proliferative response to CII were analysed by two-way ANOVA followed by Sydak's post-test for multiple comparisons between unstimulated and CII-stimulated splenocytes and one-way ANOVA followed by Dunnett's post-test for comparison of CII-stimulated response in different experimental groups with the vehicle-treated group. The data are presented in FIG. 22.

CII induced a highly significant increase of $^3$H-thymidine incorporation (cpm) when compared to the unstimulated splenocytes in the vehicle-treated group ($p<0.0001$).

The groups treated with biotherapeutic #433 demonstrated significantly lower levels of CII-induced splenocyte proliferation than the vehicle-treated group.

Cytokine Levels in Tissue Culture Supernatants

Levels of each cytokine were measured in tissue culture supernatants derived from anti-CD3/CD28 stimulated cultures by luminex analysis. These showed robust responses for all cytokines measured (mean levels in vehicle group were as follows: IL-4=6,406 pg/ml; IL-6=306 pg/ml; IL-10=10,987 pg/ml; IL-17A=11,447 pg/ml; IFN-γ=15,581 pg/ml; TNF-α=76 pg/ml).

The following sections summarise the data obtained from the Collagen II-stimulated cultures. Where applicable, statistical analyses of the differences between cytokine levels in supernatants of unstimulated and CII-stimulated splenocytes were conducted using two-way ANOVA followed by Sidak's post-test for multiple comparisons, while one-way ANOVA followed by Dunnett's post-test was used for comparison of CII-stimulated response in biotherapeutic-treated groups with the vehicle-treated group. There was no significant difference in cytokine levels between the groups in both cases. This is likely due to the small sample size used (n=3).

In order to more accurately present the distribution of the data for the cytokines with substantial spread of the data, these are presented as scatter plots.

The group means of IL-4 in tissue culture supernatants after stimulation with CII were <5 pg/ml. These are not considered biologically significant and not included here. The group means of TNF-α in tissue culture supernatants after stimulation with collagen were below limit of quantitation.

Figure 23:
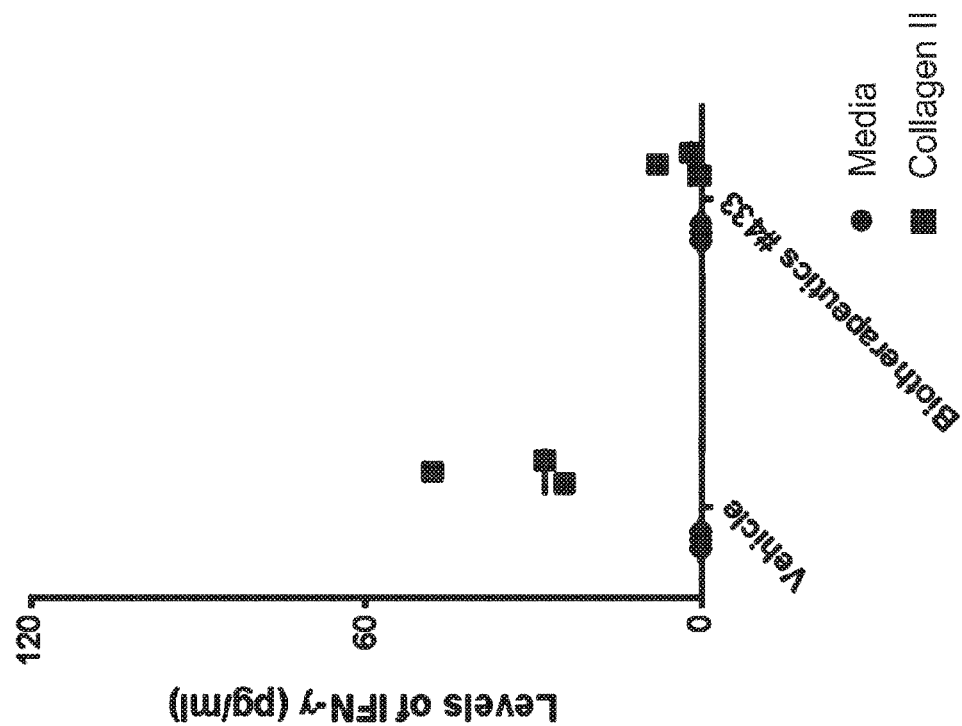
FIG. 23: Mouse model of rheumatoid arthritis—Levels of IFNγ in tissue culture supernatants. Lines represent group median values.

Supernatant Levels of IFN-γ (FIG. 23)

Along with IL-17, IFN-γ is the major cytokine driving disease in the CIA model. The scatter plot in FIG. 23 demonstrates IFN-γ levels after CII stimulation, with group median being higher for the Vehicle-treated group compared to the biotherapeutic.

Figure 24:
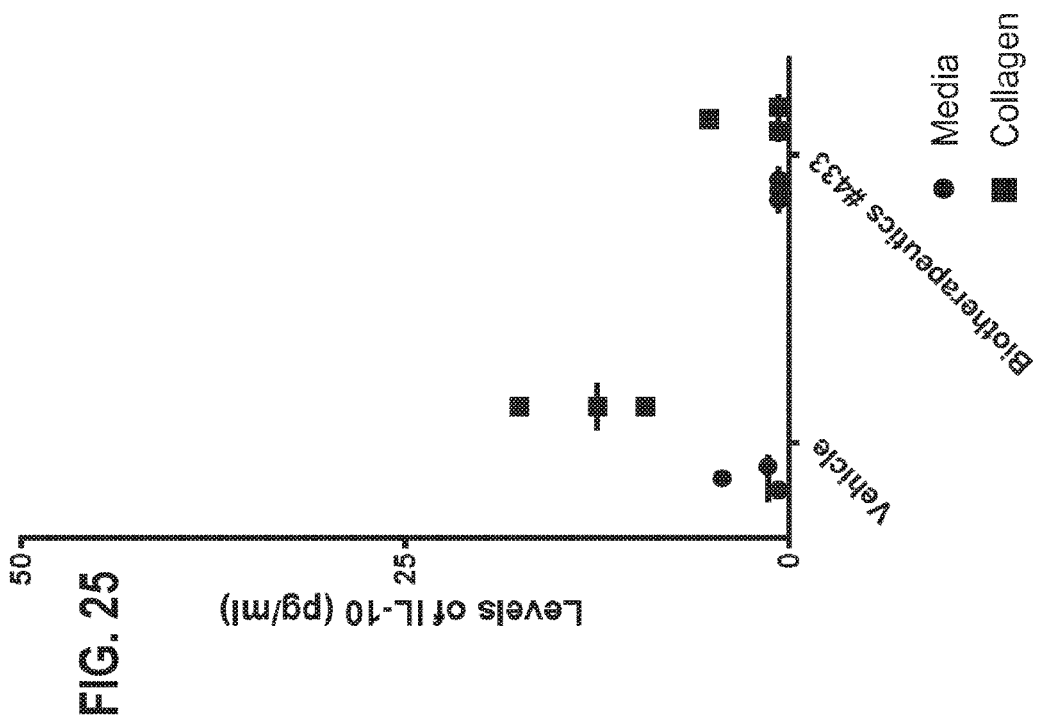
FIG. 24: Mouse model of rheumatoid arthritis—Levels of IL-17A in tissue culture supernatants. Lines represent group median values.

Supernatant Levels of IL-17A (FIG. 24)

Levels of IL-17A were 50 pg/ml in CII-stimulated cultures for the Vehicle-treated group. The levels of this cytokine appeared to be lower in the biotherapeutic group compared to the Vehicle-treated.

Figure 25:
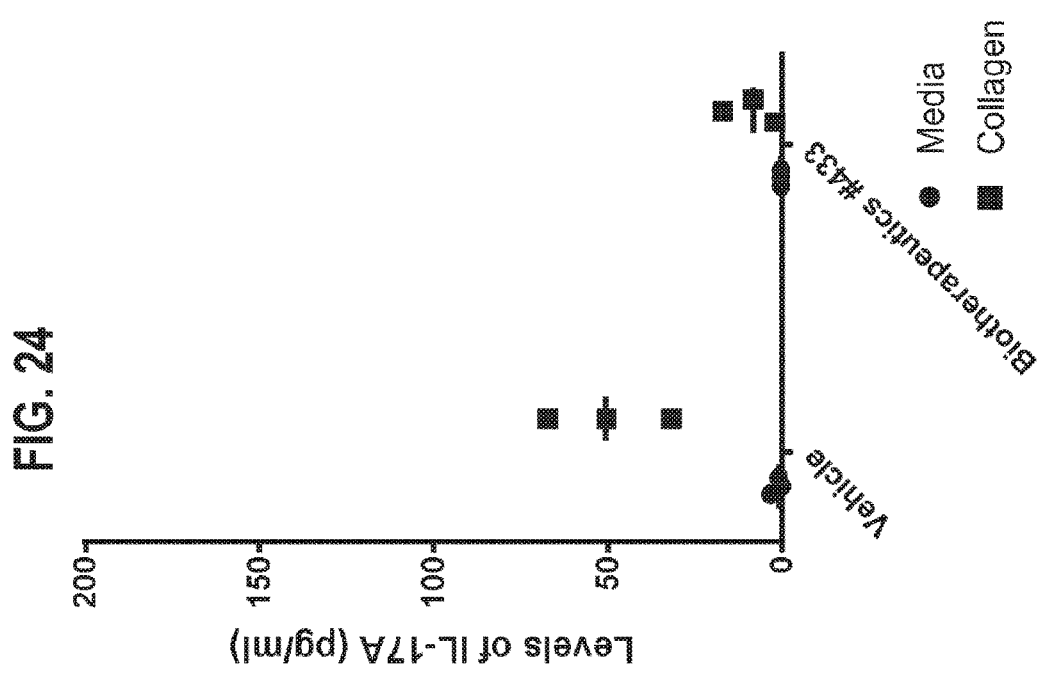
FIG. 25: Mouse model of rheumatoid arthritis—Levels of IL-10 in tissue culture supernatants. Lines represent group median values.

Supernatant Levels of IL-10 (FIG. 25)

Levels of IL-10 in Vehicle-treated group were 13 pg/ml and 2.1 pg/ml for CII-stimulated, and media control cultures, respectively. Higher levels of IL-10 (which is an anti-inflammatory cytokine) for the vehicle-treated group may be expected because inflammation and pro-inflammatory cytokine induction could be accompanied by an anti-inflammatory feedback mechanism.

Figure 26:
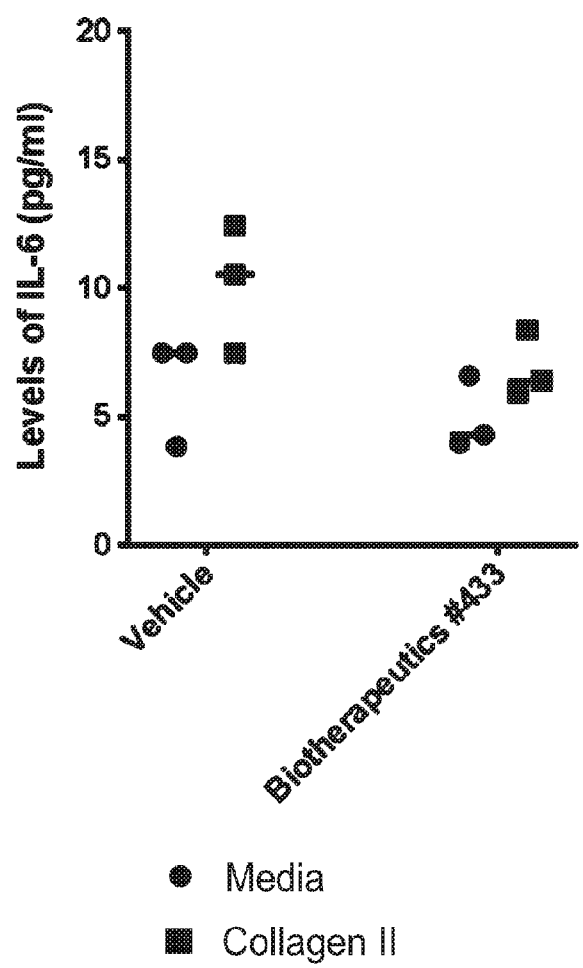
FIG. 26: Mouse model of rheumatoid arthritis—Levels of IL-6 in tissue culture supernatants. Lines represent group median values.
Figure 27:
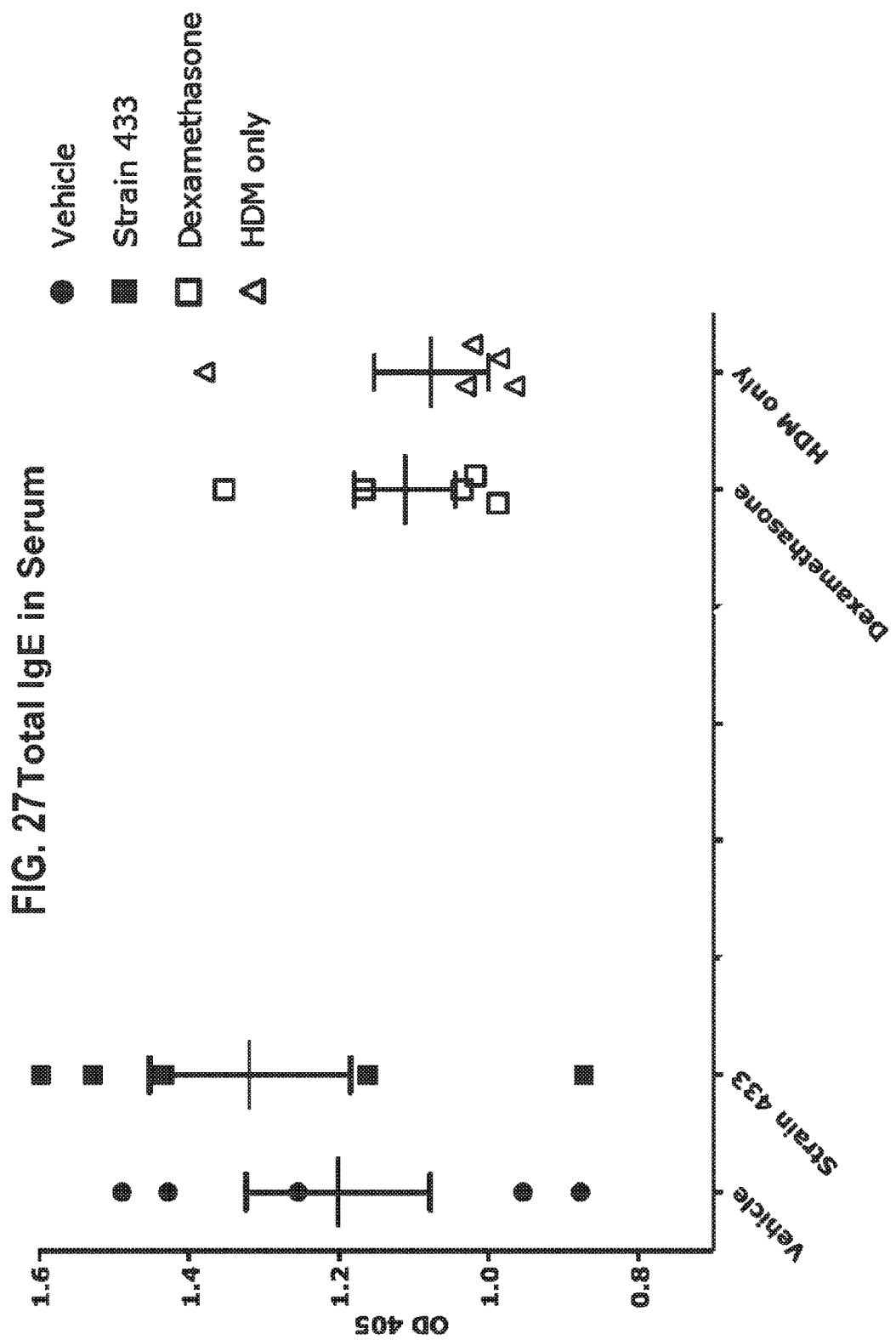
FIG. 27: Mouse model of house dust mite-induced asthma—Total IgE in Serum
Figure 28:
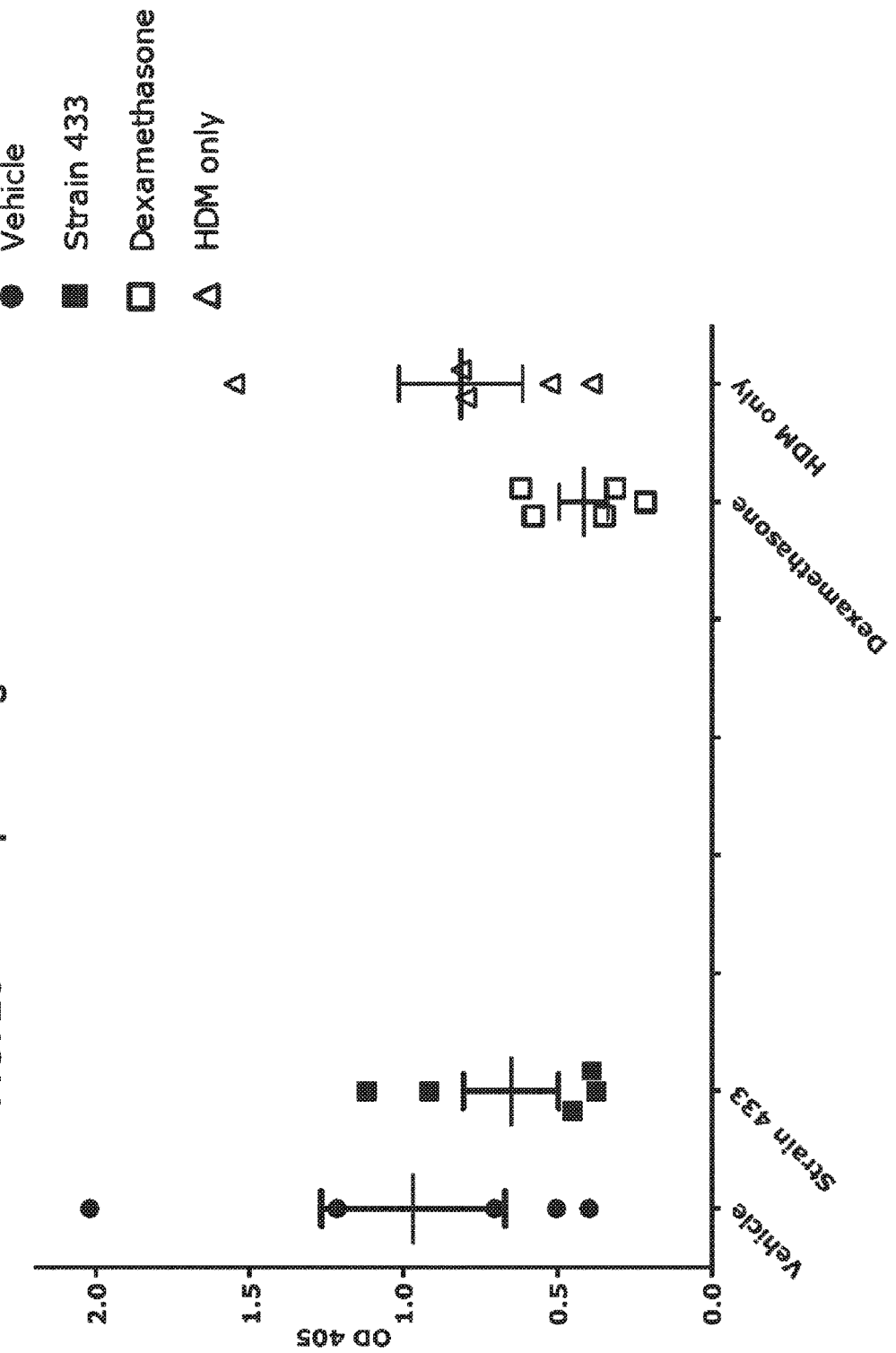
FIG. 28: Mouse model of house dust mite-induced asthma—HDM specific IgG1 in Serum
Figure 29:
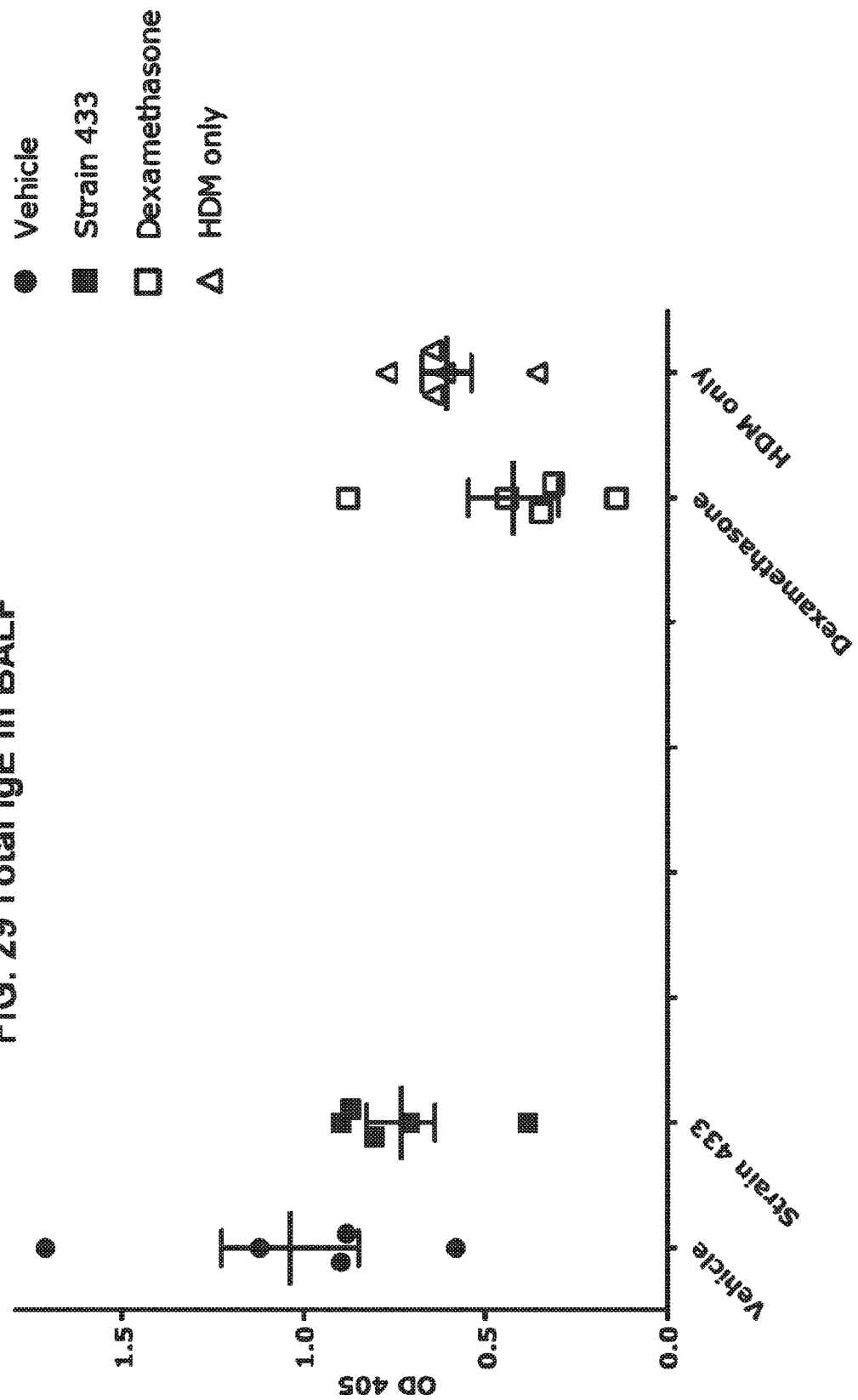
FIG. 29: Mouse model of house dust mite-induced asthma—Total IgE in BALF
Figure 30:
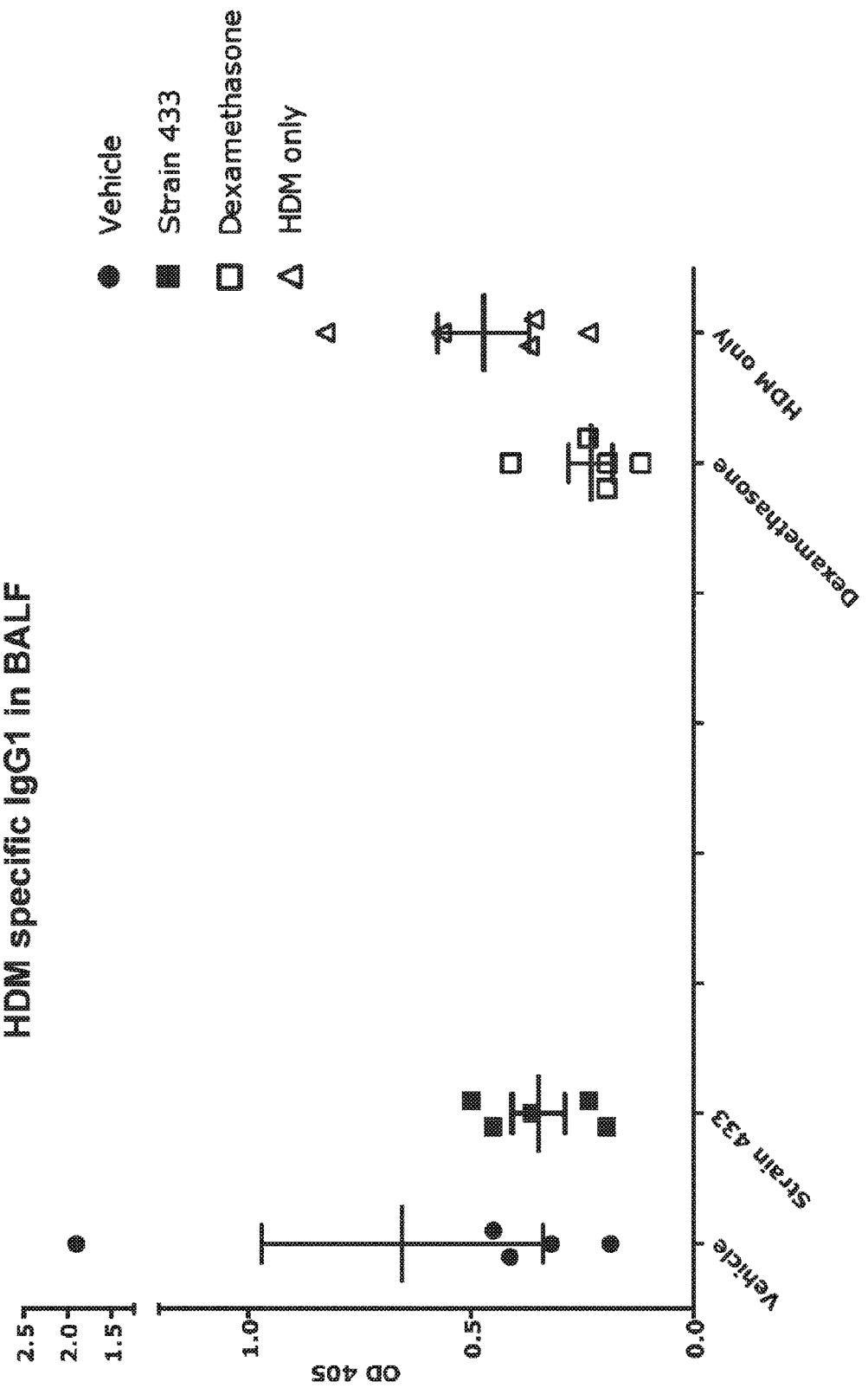
FIG. 30: Mouse model of house dust mite-induced asthma—HDM specific IgG1 in BALF

Supernatant Levels of IL-6 (FIG. 26)

Inflammatory cytokines such as IL-6 and TNF-α are not typically produced at high levels in anti-CII cultures. However, their levels may be altered as a result of immune modulation. Levels of IL-6 in CII-stimulated cultures were modest, reaching 10 pg/ml. Although higher than in media control cultures, these differences were too small to provide rationale for performing statistical analyses.

Microbiological Analysis

Bacterial growth was confirmed by measuring the optical density at 600 nm using a spectrophotometer. Bacterial identity was confirmed by comparing streaked plate pictures to reference pictures.

Following the improved bacterial preparation method, consistently high doses of bacterial strain were administered from Day −2 and Day −3 as indicated by the high OD values measured.

Faecal samples were collected and snap-frozen on Day −14, Day 0 and at termination.

Histopathology

The histopathology results are shown in FIGS. 65-69. As expected for this model, intra-individual and inter-individual variability was observed in terms of the presence/absence of arthritis or the severity of change present.

The nature of the pathology was as expected for this model, with extensive mixed chronic-active inflammation of the synovium and bursa extending to involve the peri-articular soft tissues (muscle, adipose tissue, dermal collagen). In the most severely affected joints there was articular cartilage degeneration and loss with intra-articular debris and inflammation and disruption of the joint and bone structure by fibrosis and inflammation.

The incidence of histopathological changes was: vehicle—80% (16/20); Biotherapeutic #433-55% (12/22). Treatment with Biotherapeutic #433 reduced the incidence of histopathological scores in mouse hind limbs when compared to the vehicle-treated group (see FIGS. 65-68). Histopathology scores were analysed by one-way ANOVA for non-parametric data (Kruskal-Wallis test) followed by Dunn's post-test for multiple comparisons to the vehicle-treated group, although the reduction achieved by Biotherapeutic #433 was not statistically significant in this analysis. Biotherapeutic #433 induced a reduction of the joint inflammation scores observed in histopathology when compared to the vehicle-treated group. Biotherapeutic #433 induced a reduction of the cartilage damage scores observed in histopathology when compared to the vehicle-treated group. Biotherapeutic #433 induced a reduction of the bone damage scores observed in histopathology when compared to the vehicle-treated group. Biotherapeutic #433 induced a reduction of the total histopathology scores when compared to the vehicle-treated group.

Summary

Increased clinical scores were observed from Day 28 after the first administration of type II collagen, as expected in this model of arthritis in DBA/1 mice. Biotherapeutic #433 was shown to be effective at treating arthritis in this model. Biotherapeutic #433 was effective for reducing the severity of the clinical scores and for reducing pathological disease in the joints, as demonstrated in the histopathological analysis.

Proliferative recall responses to Collagen II were seen in splenocyte cultures from all experimental groups. The collagen-specific response was significantly reduced following treatment with biotherapeutic #433 (Group 5).

Most of the T cell cytokines tested showed detectable increases between Collagen II-stimulated and media controls in the Vehicle-treated group. These increases were not as obvious in the biotherapeutic-treated group. This broadly supports the proliferative recall responses to Collagen II described above.

There was evidence of suppression of the Th1/Th17 axis, which is the pathogenic response in this model and in human RA. Correlation of reduced levels of cytokines with reduced proliferation is suggestive of immune modulation. There was no evidence that this modulation resulted either from enhanced levels of Th2 associated IL-4 or with increases in the immune modulating cytokine, IL-10.

Example 4

Further Analysis of the Effect of Bacterial Inocula in the Mouse Model of House Dust Mite-Induced Asthma The mice tested in Example 1 were subjected to further analyses to further characterise the effect of the compositions of the invention on the allergic asthma inflammatory response.

Materials and Methods

Blood withdrawal and serum preparation on day 14. Blood samples of animals were collected via cardiac puncture. Serum was isolated from the blood sample by centrifugation for 5 min at 14000 g and stored at −20° C.

Organ removal on day 14. Collection of the left lung lobe in formalin for follow-on histological analysis. Collection of the right lung lobes (all remaining lobes) and removal of serum for snap freezing and follow-on analysis. Remaining BAL fluid was snap frozen for follow-on analysis.

Measurement of Antibody Levels in Serum and BAL Fluid

Total IgE and house-dust-mite (HDM) specific IgG1 antibody production were measured in the BAL and serum by ELISA assay.

Isolation of Lung and Histological Analysis

Left lung lobes were fixed in formalin followed by embedment in paraffin, sectioning, and staining with hematoxylin and eosin and PAS. Subsequent histological scoring was performed blinded as followed: Five random fields of view per sample were scored for inflammation (peribronchial infiltration and perivascular infiltration) and mucus production. Inflammatory infiltration was scored with the following grading system:

0—normal
1—mild inflammatory infiltrates
2—moderate inflammatory infiltrates

3—marked inflammatory infiltrates
4—severe inflammatory infiltrates
5—very severe inflammatory infiltrates In each field of view, airways were measured in size and mucus cell numbers were quantified/um.

Measurement of Inflammatory Mediators in Lung Tissue

Right lung lobes (all remaining lobes) isolated for quantification of inflammatory mediators were snap frozen for subsequent measurement of CCL11, IFN-gamma, IL-1 alpha, IL-1 beta, IL-4, IL-5, IL-9, IL-17A, CXCL1, CCL3, CXCL2 and CCL5 by commercially available multiplex assay (Merck-Millipore). Analysis was performed according to the manufacturer's instructions.

Results and Analysis

The results of the experiments are shown in FIGS. 27-45.

Figure 31:
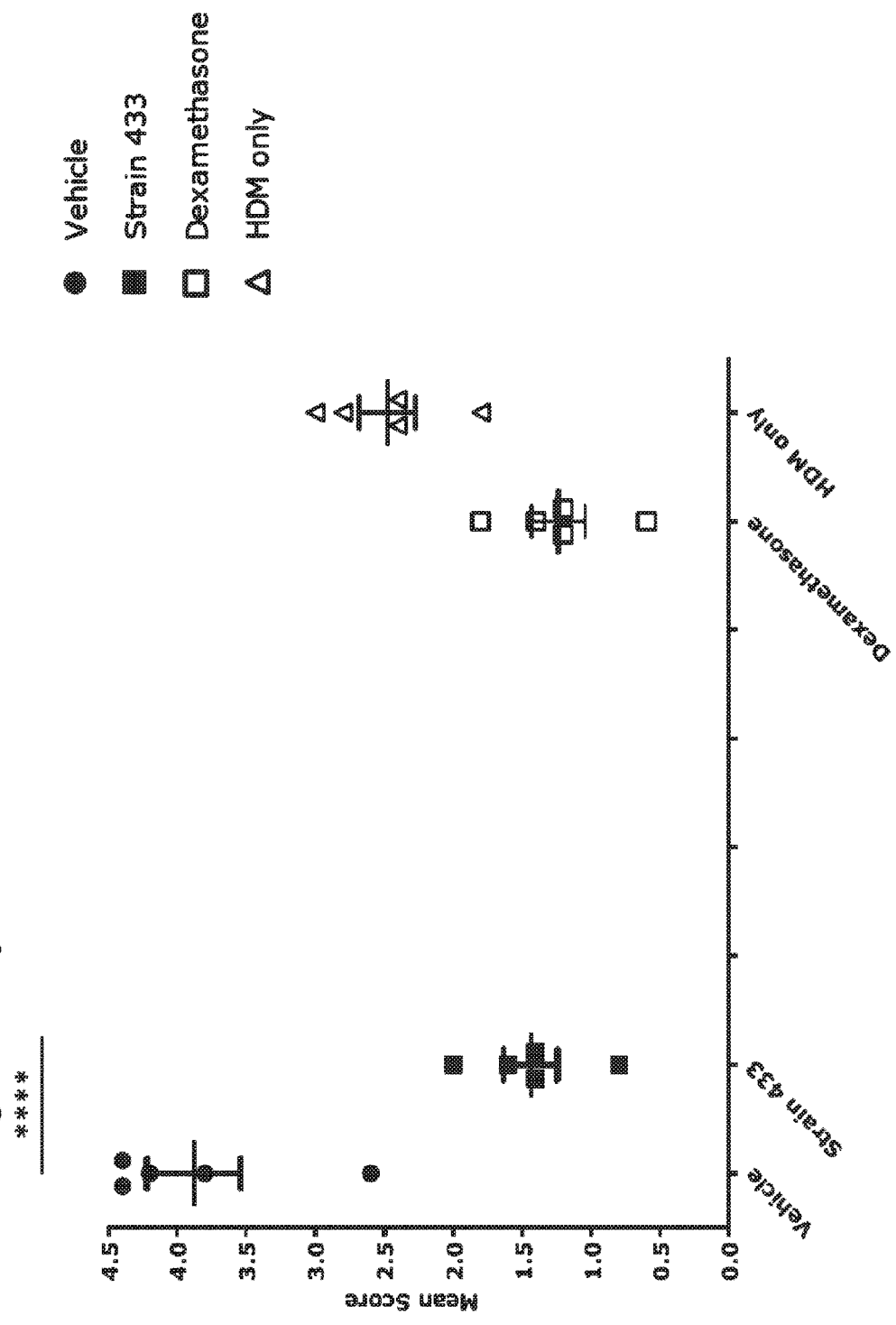
FIG. 31: Mouse model of house dust mite-induced asthma—Histological Analysis—Mean Peribronchiolar Infiltration Score
Figure 32:
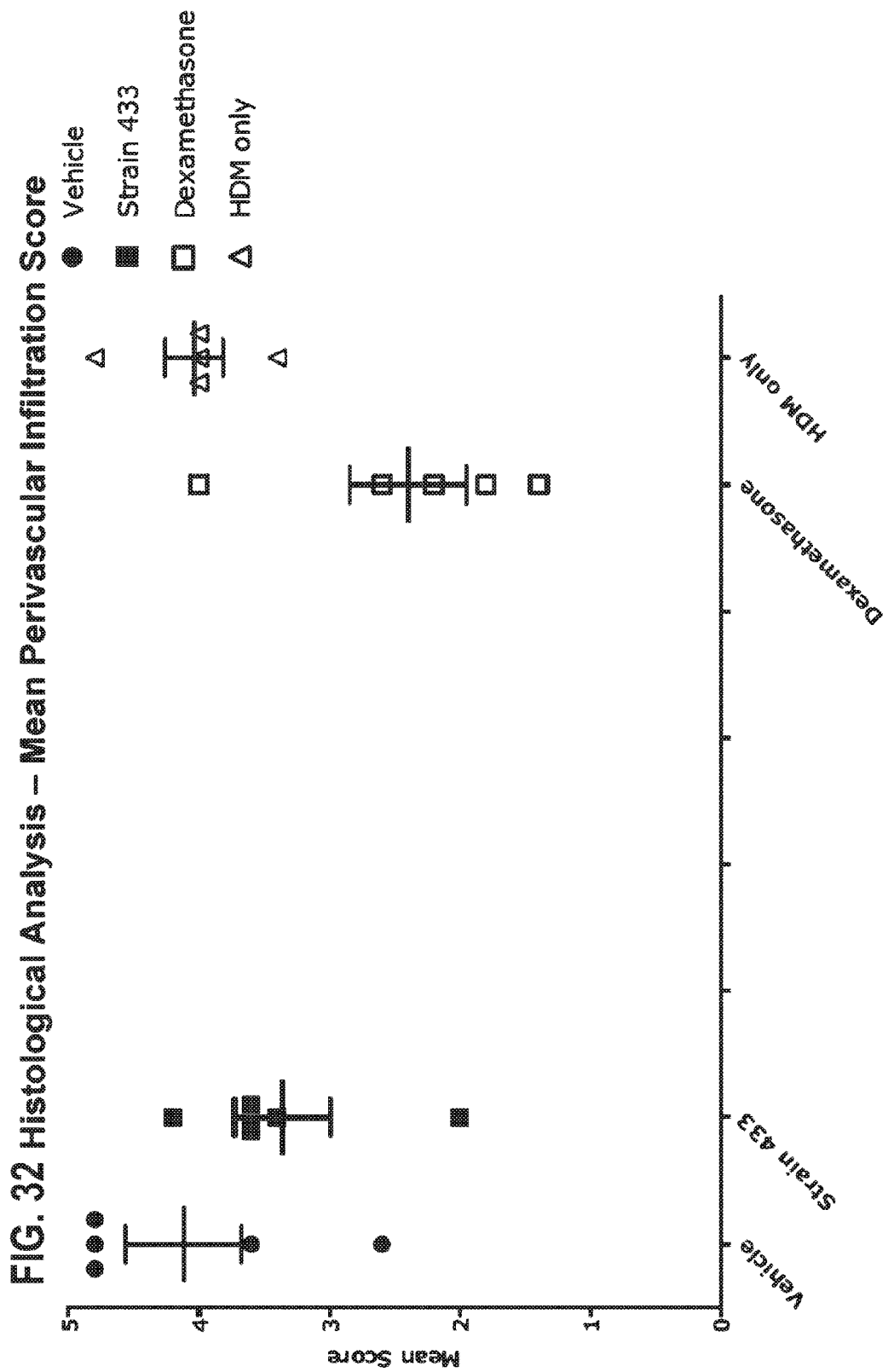
FIG. 32: Mouse model of house dust mite-induced asthma—Histological Analysis—Mean Perivascular Infiltration Score
Figure 33:
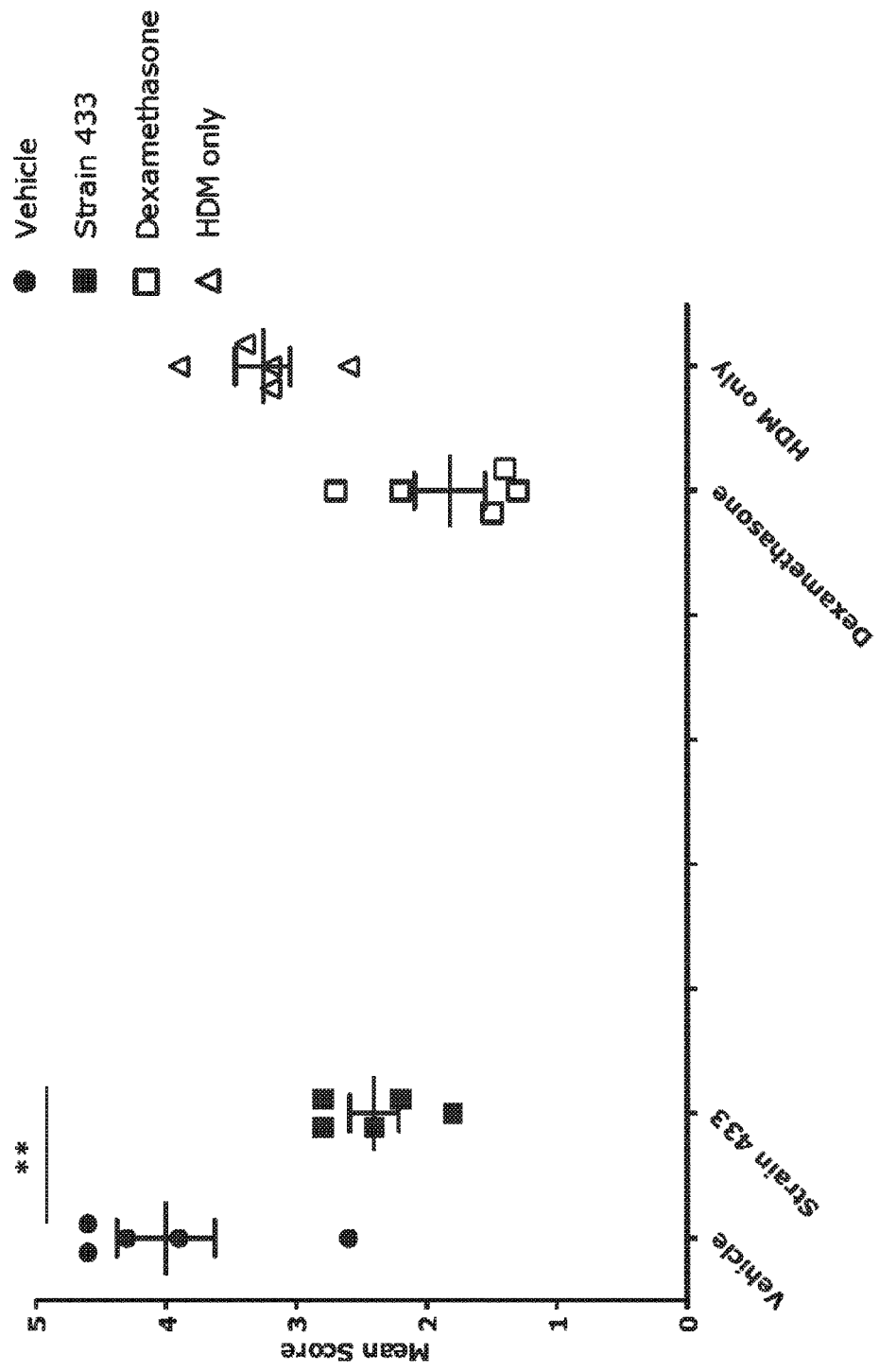
FIG. 33: Mouse model of house dust mite-induced asthma—Histological Analysis—Mean Inflammatory Score (Average of both Peribronchiolar and Perivascular Infiltration Score)
Figure 34:
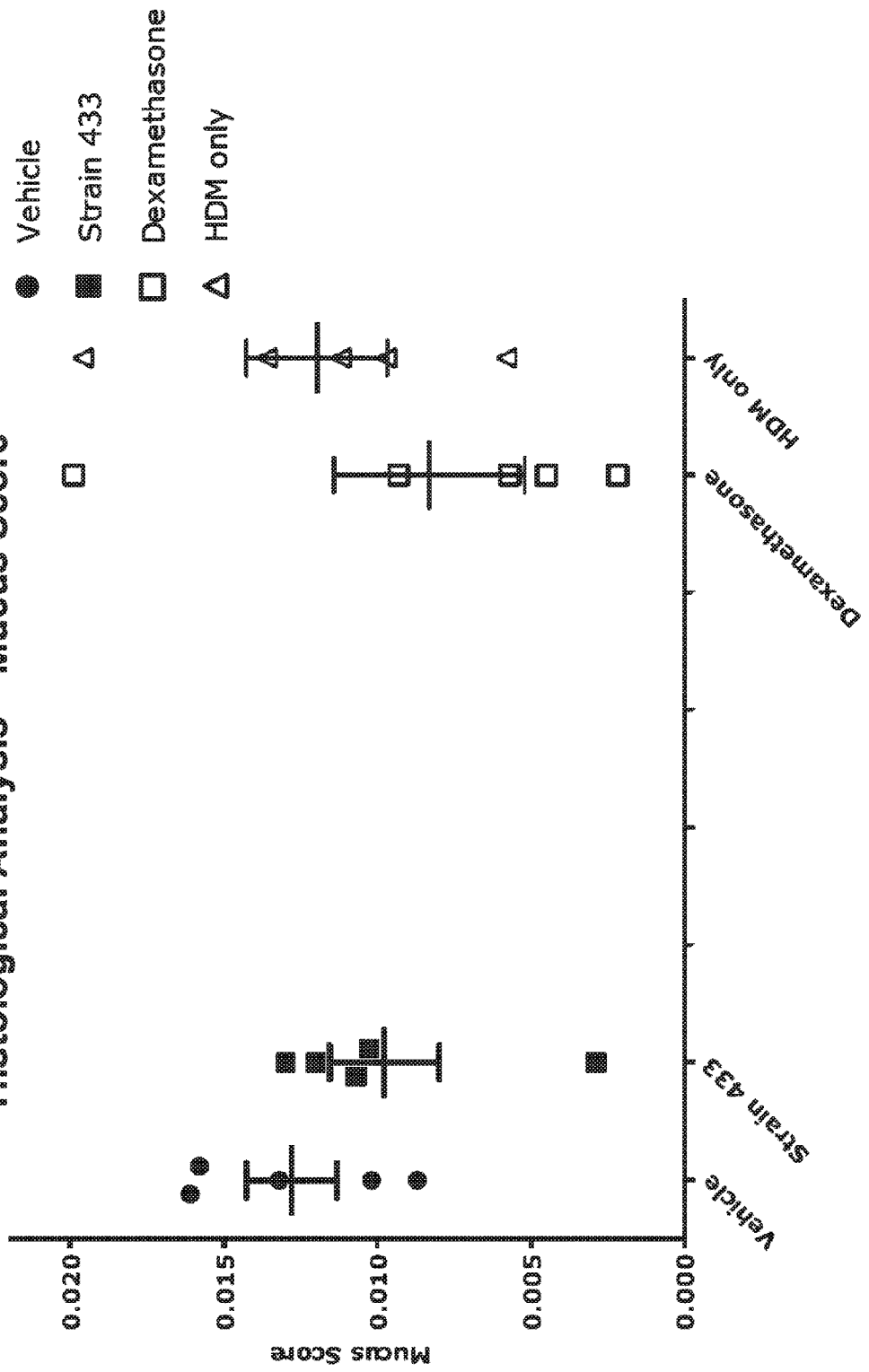
FIG. 34: Mouse model of house dust mite-induced asthma—Histological Analysis—Mucus Score
Figure 35:
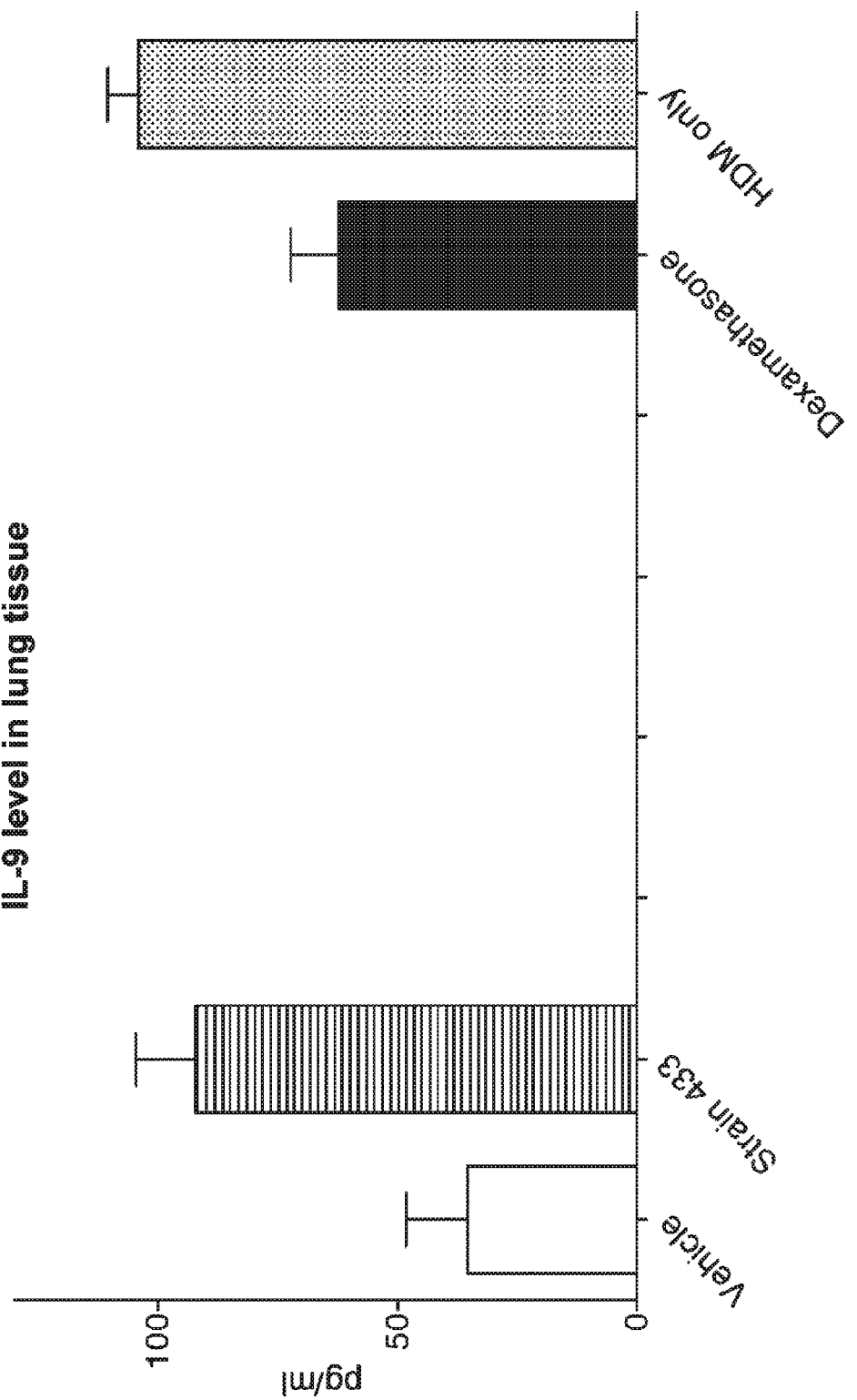
FIG. 35: Mouse model of house dust mite-induced asthma—IL-9 level in lung tissue
Figure 36:
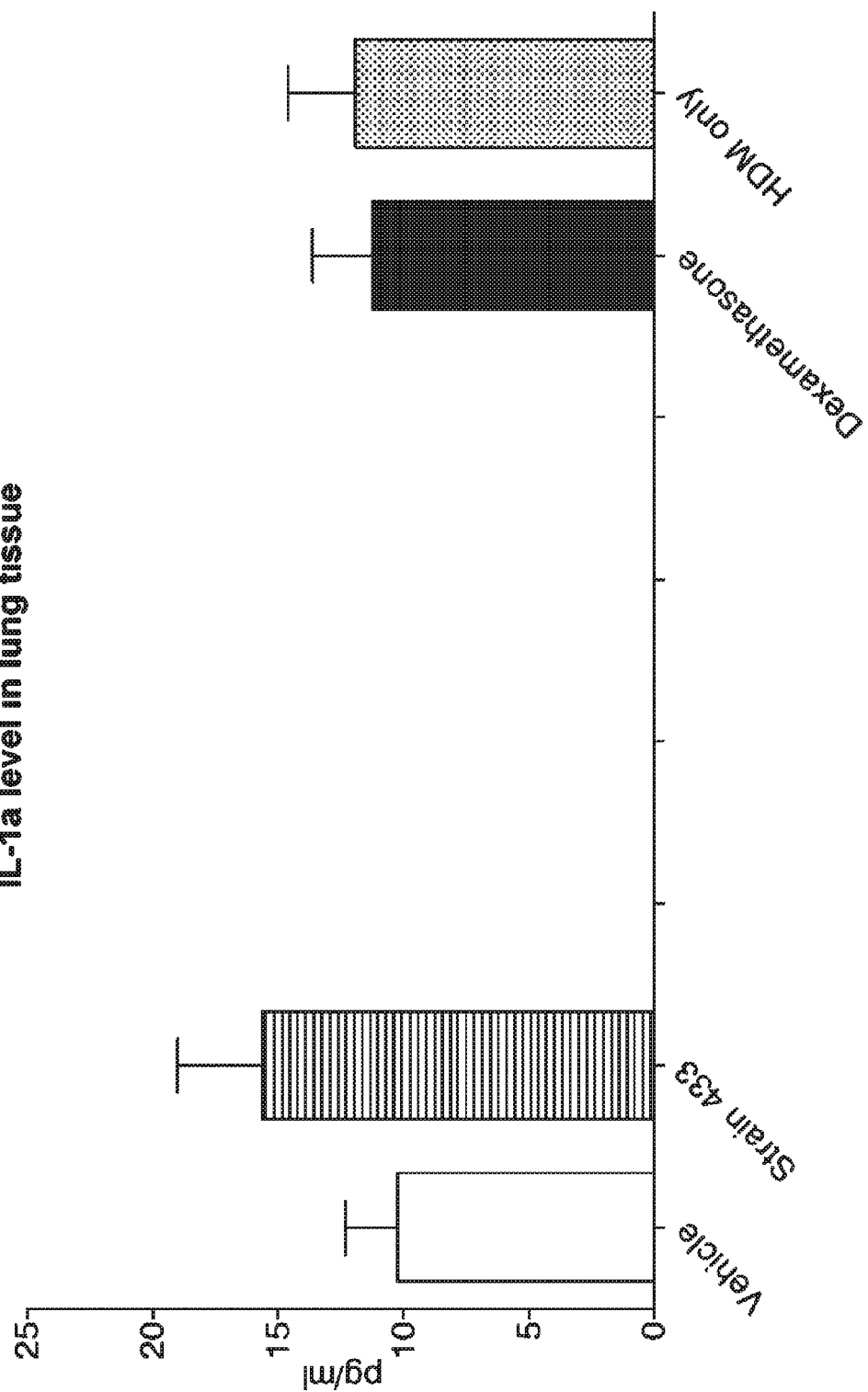
FIG. 36: Mouse model of house dust mite-induced asthma—IL-1a level in lung tissue
Figure 37:
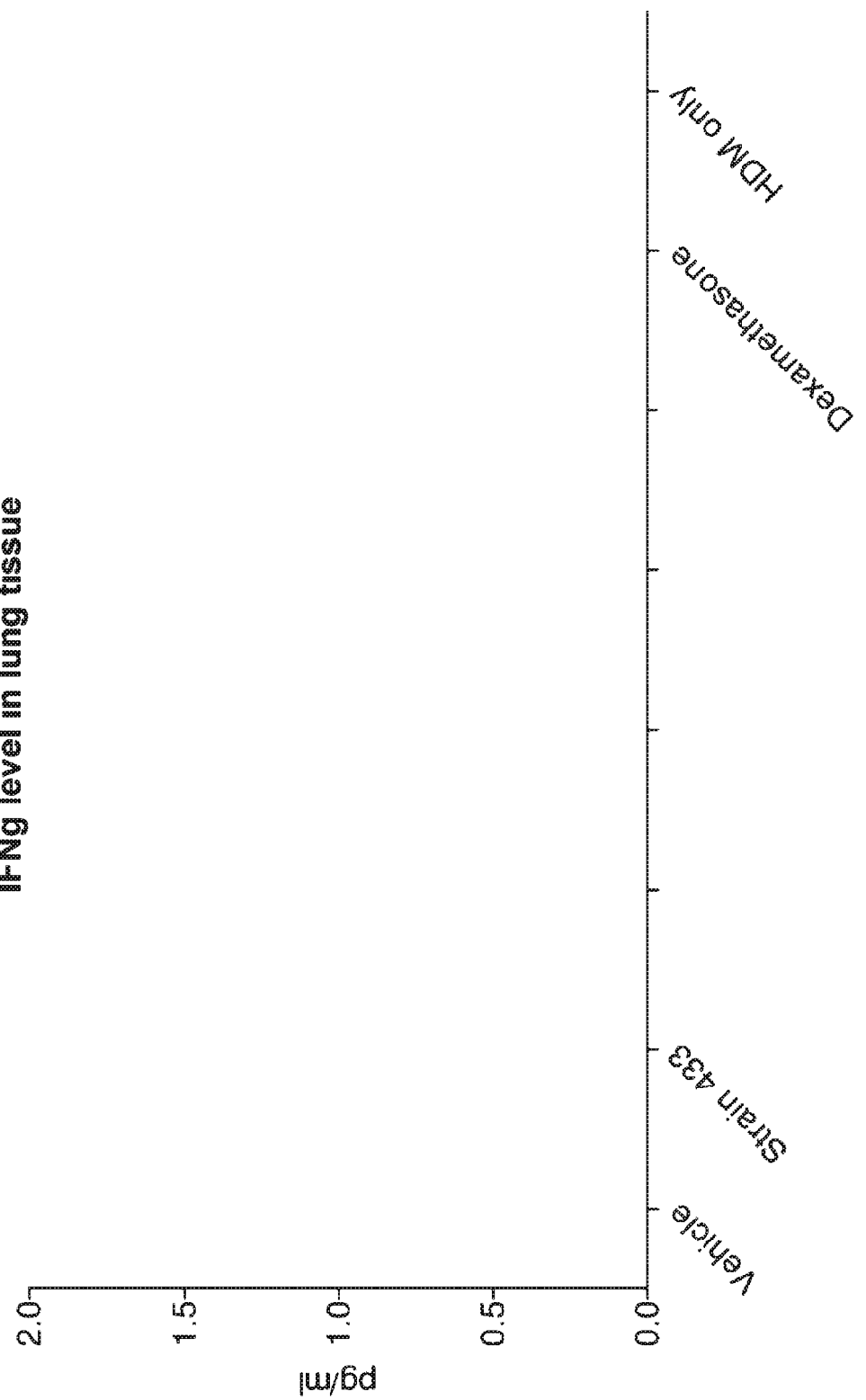
FIG. 37: Mouse model of house dust mite-induced asthma—IFNγ level in lung tissue
Figure 38:
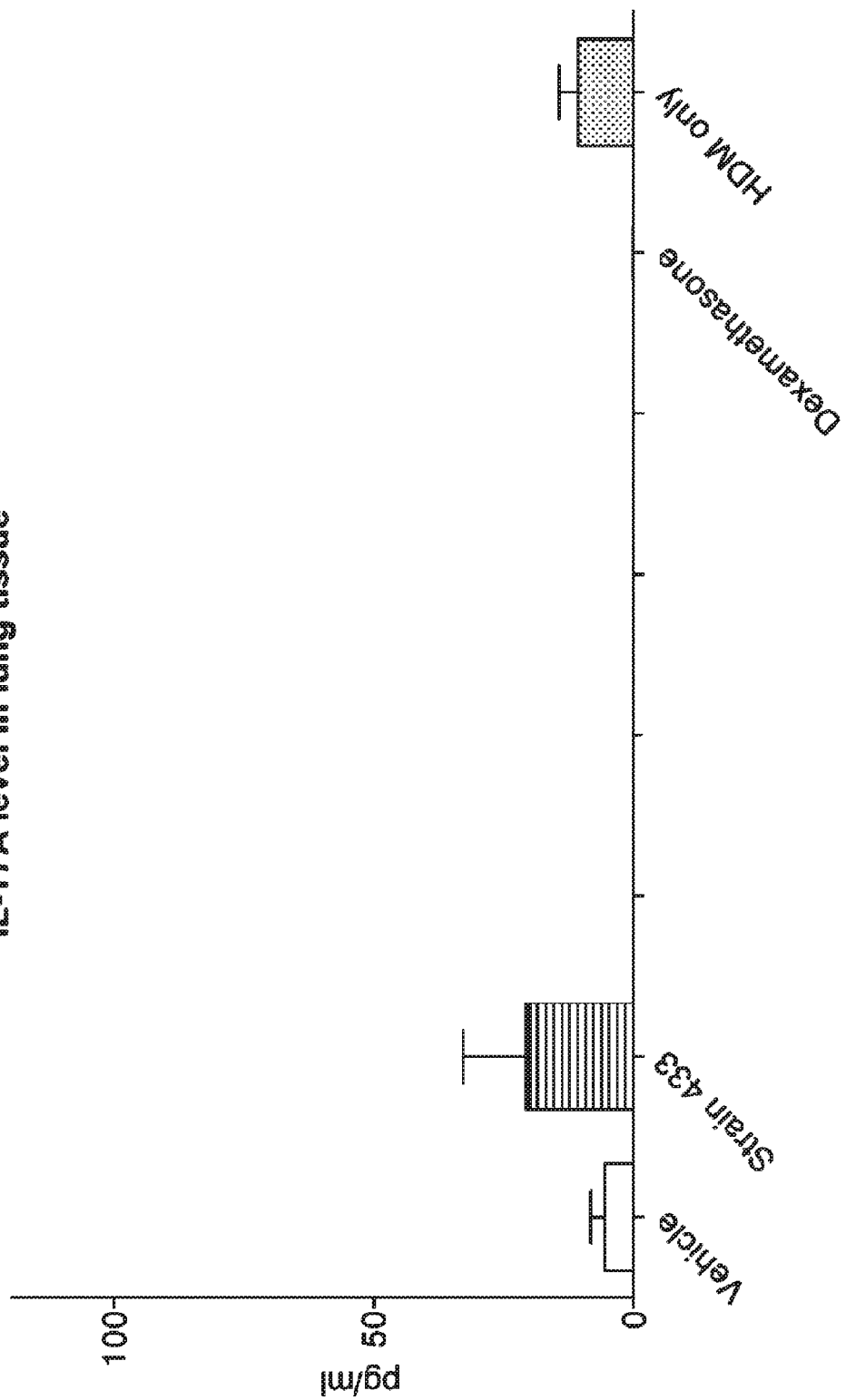
FIG. 38: Mouse model of house dust mite-induced asthma—IL-17A level in lung tissue
Figure 39:
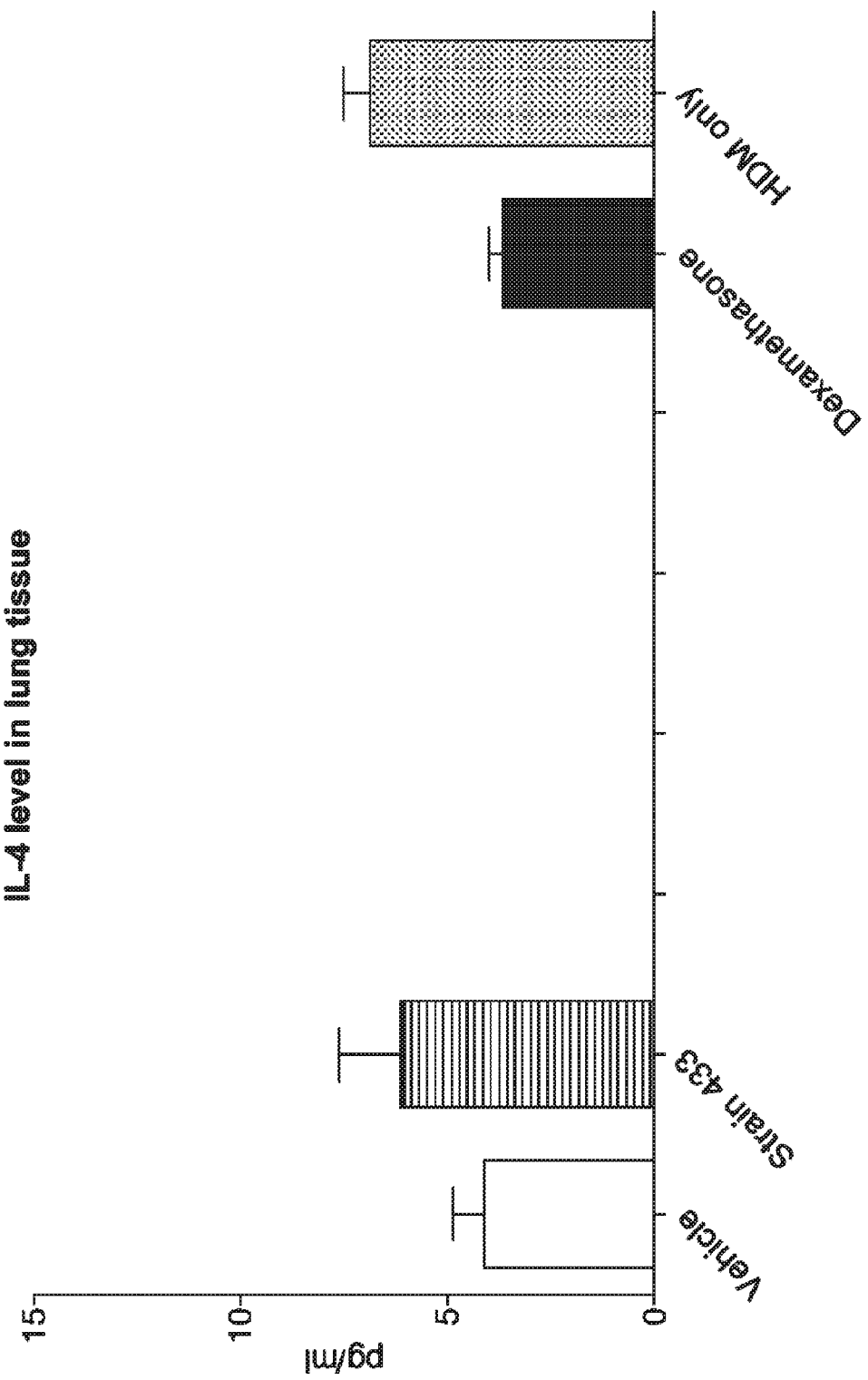
FIG. 39: Mouse model of house dust mite-induced asthma—IL-4 level in lung tissue
Figure 40:
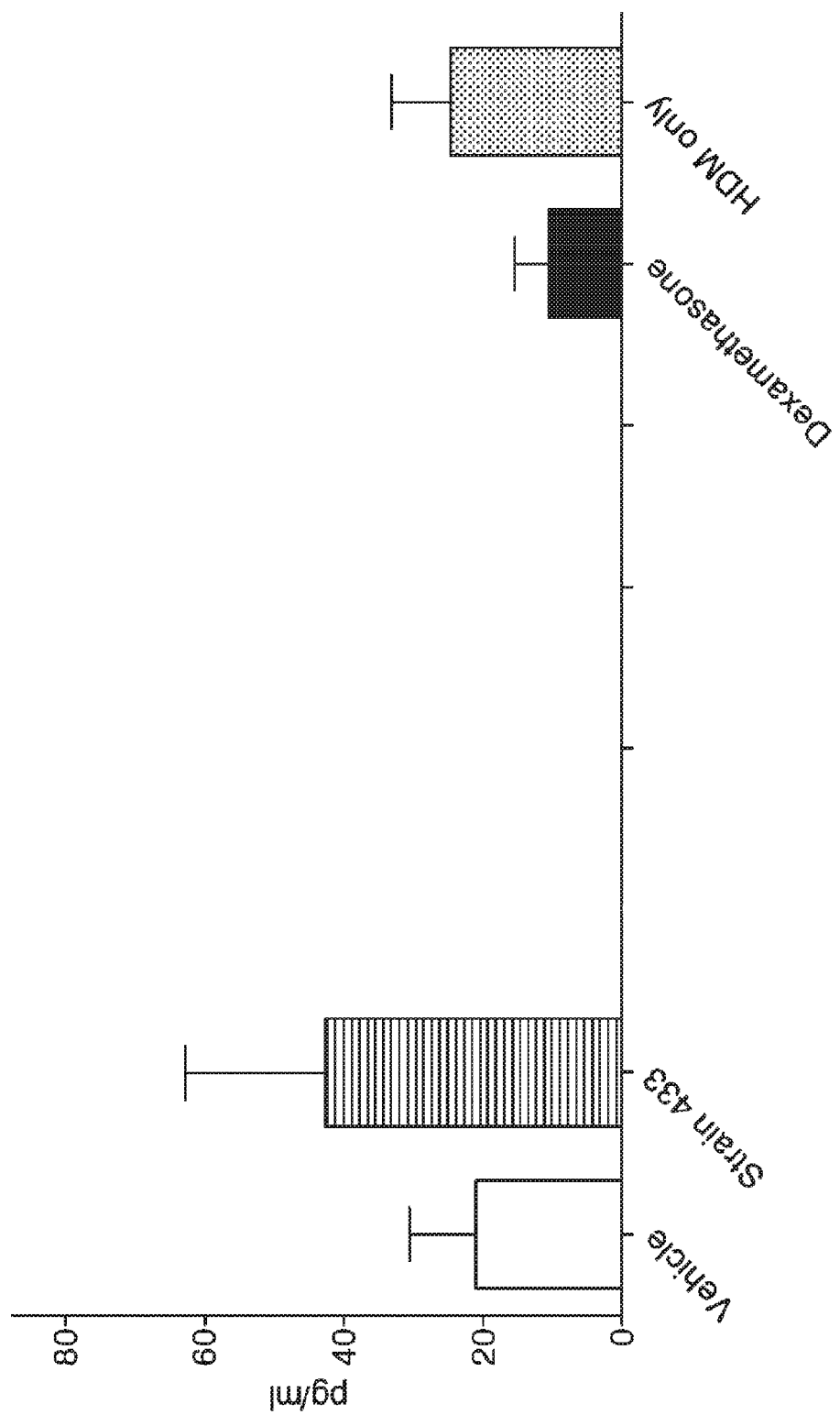
FIG. 40: Mouse model of house dust mite-induced asthma—IL-5 level in lung tissue
Figure 41:
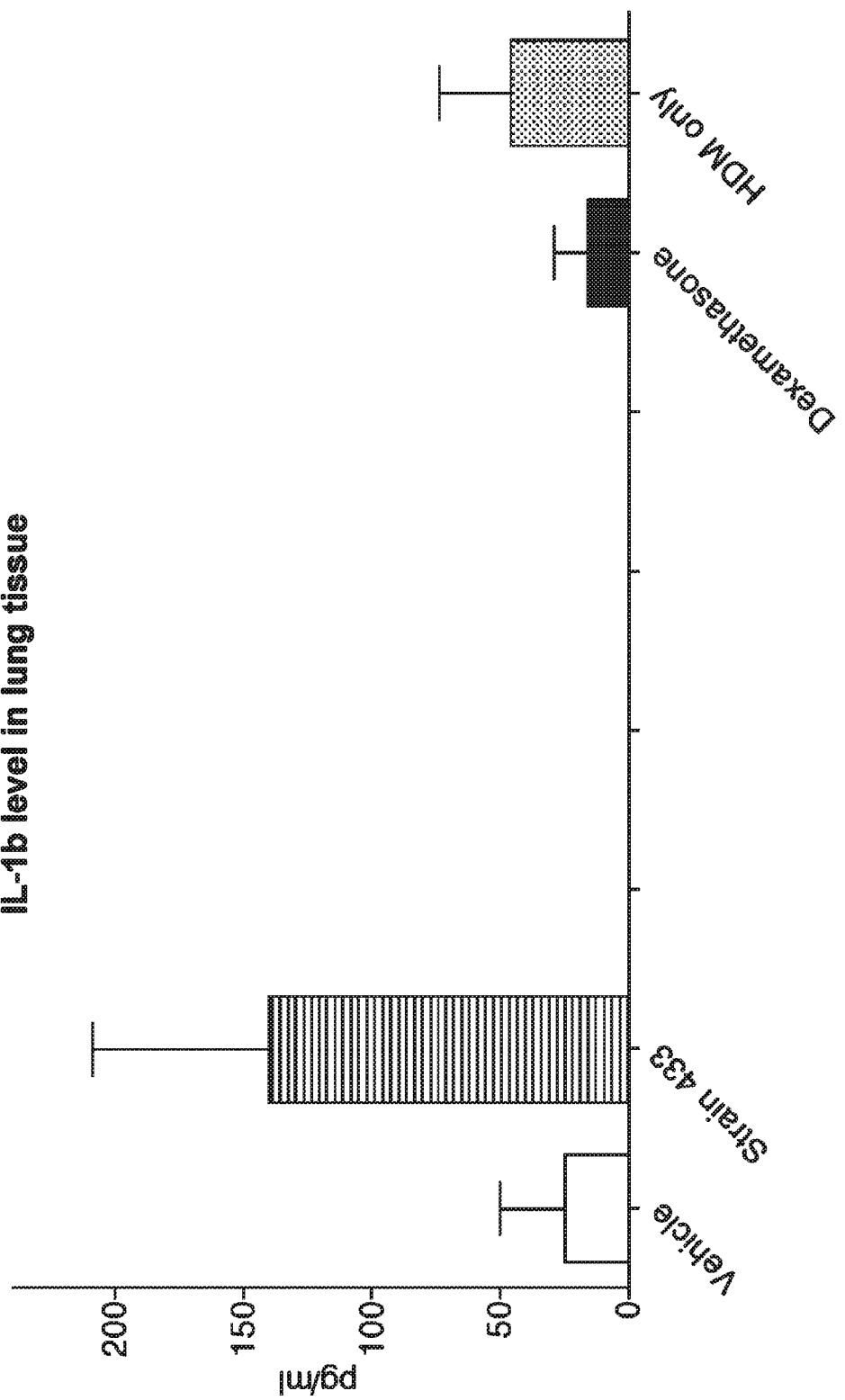
FIG. 41: Mouse model of house dust mite-induced asthma—IL-1b level in lung tissue
Figure 42:
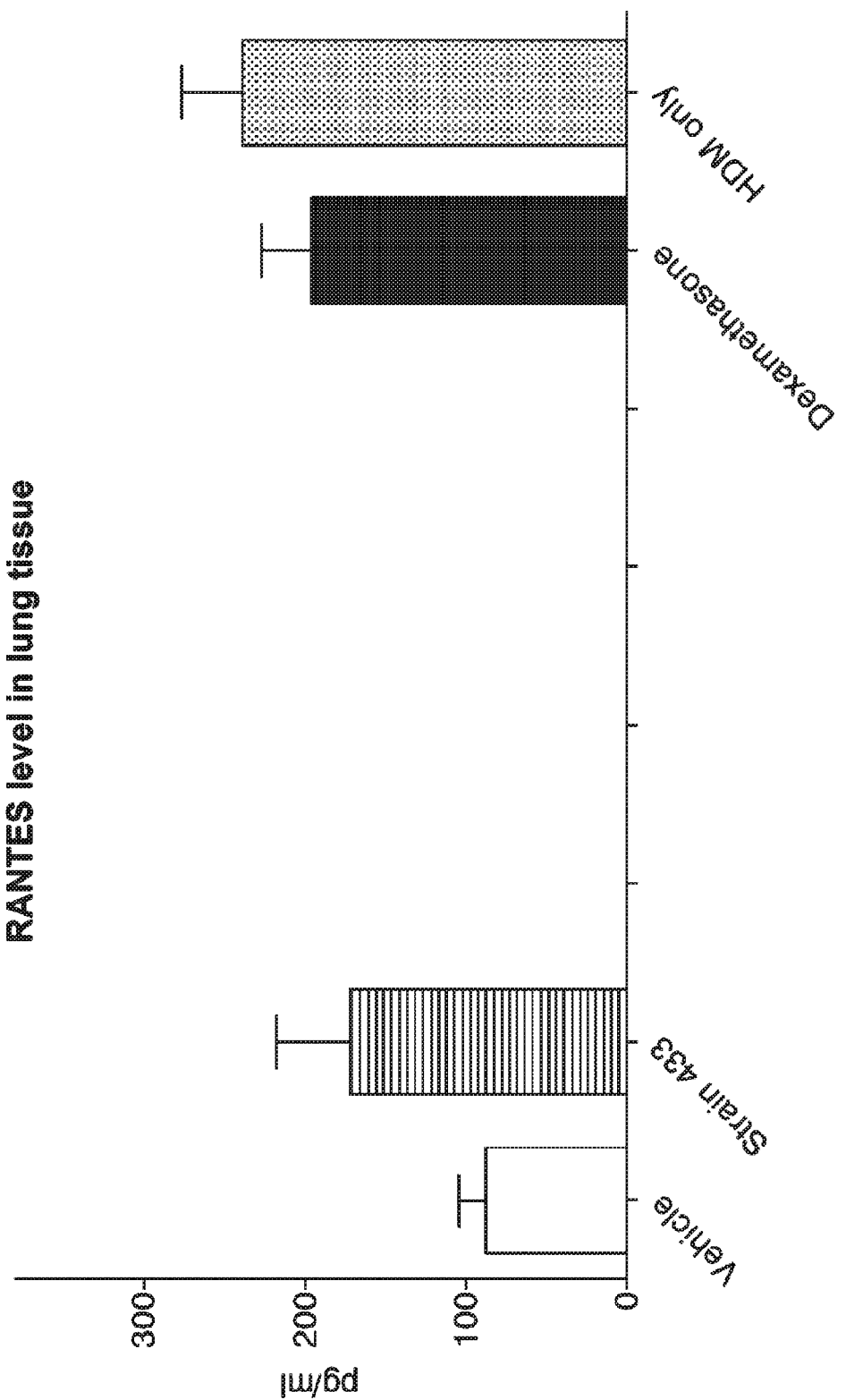
FIG. 42: Mouse model of house dust mite-induced asthma—RANTES level in lung tissue
Figure 43:
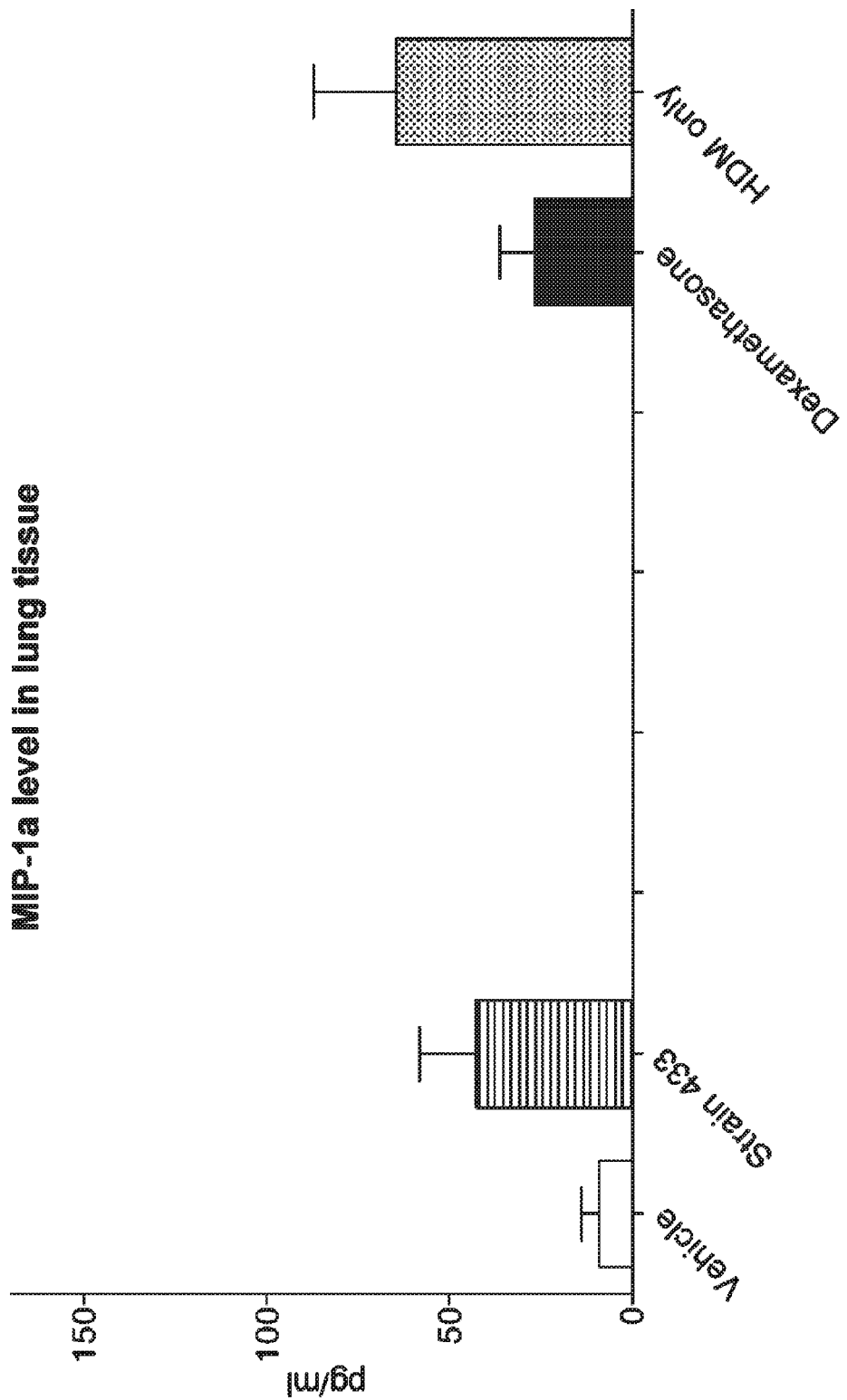
FIG. 43: Mouse model of house dust mite-induced asthma—MIP-1a level in lung tissue
Figure 44:
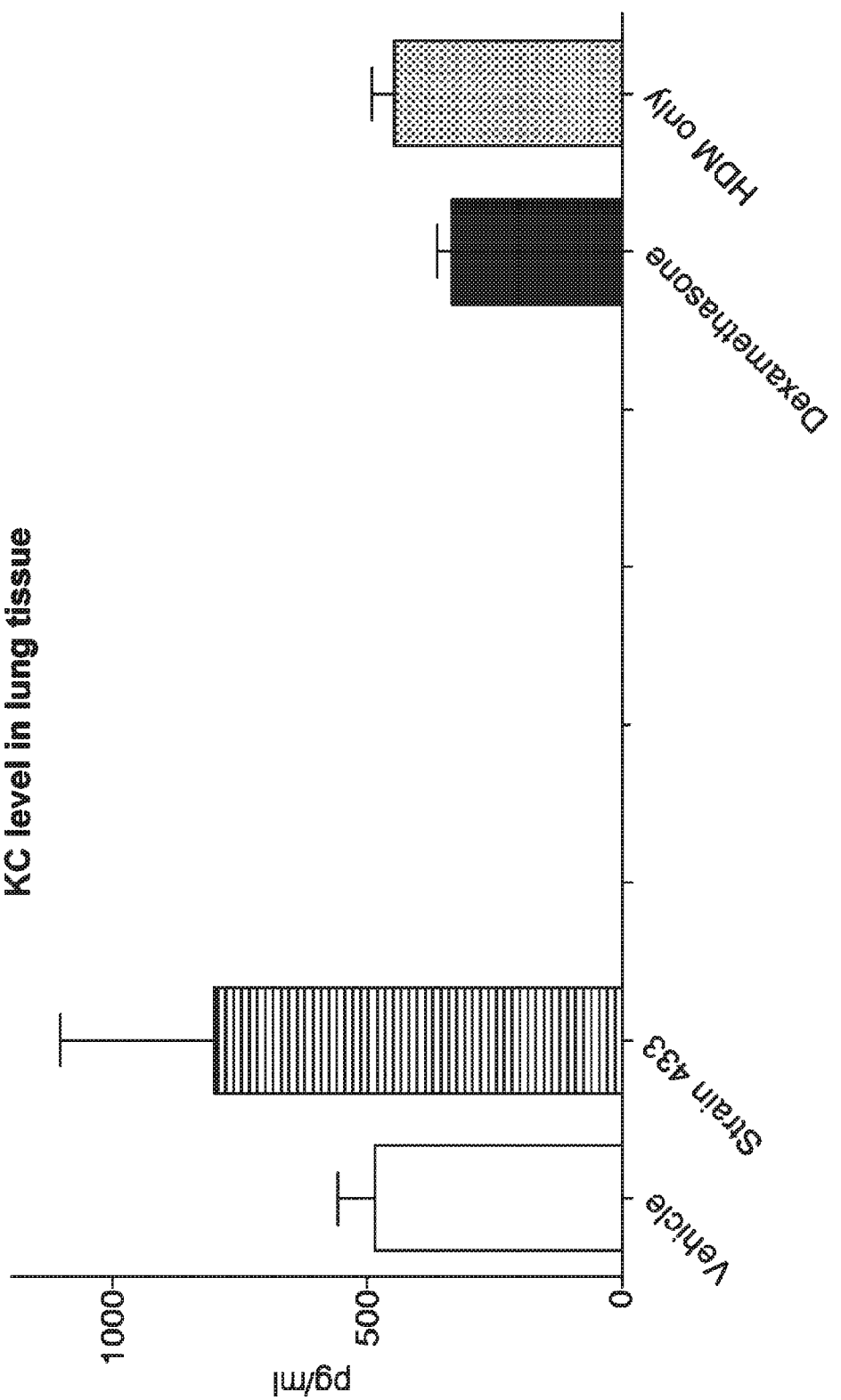
FIG. 44: Mouse model of house dust mite-induced asthma—KC level in lung tissue
Figure 45:
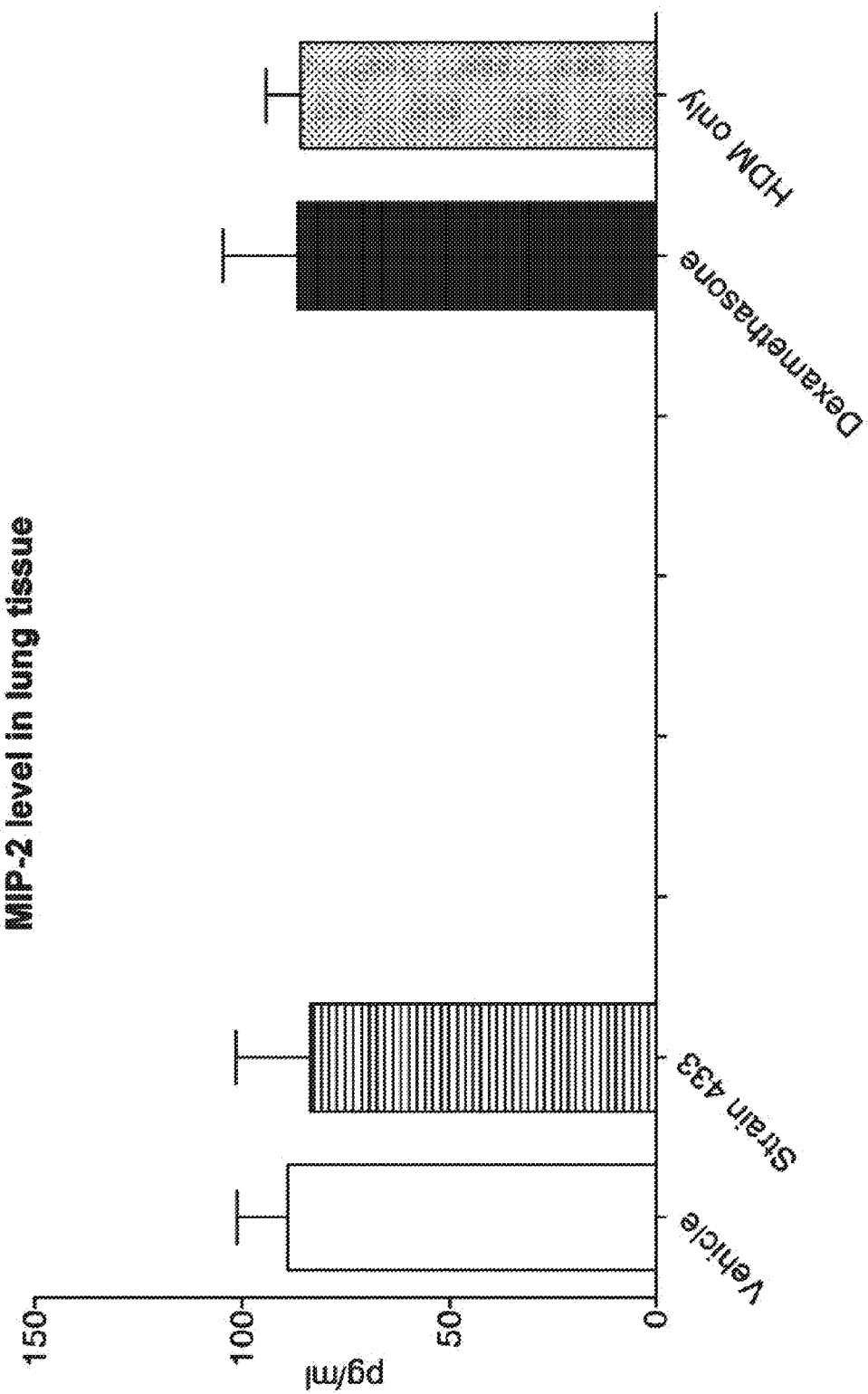
FIG. 45: Mouse model of house dust mite-induced asthma—MIP-2 level in lung tissue

In support of the findings described in Example 1, analysis of the cellular infiltrates in the lung tissue of mice treated with strain 433 showed a notable and statistically significant reduction in mean inflammation score (see FIGS. 31 and 33).

Antibody levels in the BAL fluid and serum were analysed (see FIGS. 27-30). No clear effect of the bacterial treatment on serum antibody levels was observed. This may reflect a failure in the experiment, because the spread of data and the error bars for each treatment are large, and the positive and negative controls do not appear to have behaved as would be expected. Also, the baseline serum antibody levels could have masked any changes.

Similarly, no clear effect of the bacterial treatment on cytokine levels in lung tissue was observed (see FIGS. 35-45). Again, this may reflect a failure in the experiment, because the spread of data and the error bars for each treatment are large, and the positive and negative controls do not appear to have behaved as would be expected. It is also possible that the mechanism of action involved influences earlier cytokine responses that were no longer detectable on day 4 post the final HDM airway challenge. Some care should be taken when interpreting the cytokine data in the current study, due to the variability in the levels detected. This variability could in part be explained by the fact that the lung tissue was separated for the different analyses, and thus one lung lobe might not have been fully representative or comparable to the same lobe in other mice due to patchy distribution of the inflammation.

Example 5

Further Analysis of the Effect of Bacterial Inocula in the Mouse Model of Severe Neutrophilic Asthma The mice tested in Example 2 were subjected to further analyses to further characterise the effect of the compositions of the invention on the neutrophilic response associated with severe asthma.

Materials and Methods

Organ removal on day 18. Collection of the left lung lobe in formalin for follow-on histological analysis. Collection of the right lung lobes (all remaining lobes) and removal of serum for snap freezing and follow-on analysis. Remaining BAL fluid was snap frozen for follow-on analysis.

Measurement of inflammatory mediators in lung tissue (follow-on analysis). Right lung lobes (all remaining lobes) isolated for quantification of inflammatory mediators were snap frozen for subsequent measurement of IFN-gamma, IL-1 alpha, IL-1 beta, CXCL1, CCL3, CXCL2, CCL5, IL-17A, TNF-alpha, IL-17F, IL-23 and IL-33 by commercially available multiplex assay (Merck-Millipore). Analysis was performed according to the manufacturer's instructions.

Measurement of antibody levels in serum and BAL fluid (follow-on analysis). House-dust-mite (HDM) specific IgG1 and IgG2a antibody production were measured in the BAL and serum by ELISA assay.

Isolation of lung and histological analysis (follow-on analysis). Left lung lobes were fixed in formalin followed by embedment in paraffin, sectioning, and staining with hematoxylin and eosin and PAS. Subsequent histological scoring was performed blinded as followed: Five random fields of view per sample were scored for inflammation (peribronchial infiltration and perivascular infiltration) and mucus production. Inflammatory infiltration was scored with the following grading system:
0—normal
1—mild inflammatory infiltrates
2—moderate inflammatory infiltrates
3—marked inflammatory infiltrates
4—severe inflammatory infiltrates
5—very severe inflammatory infiltrates Results and Analysis The results of the experiments are shown in FIGS. 46-63.

Figure 46:
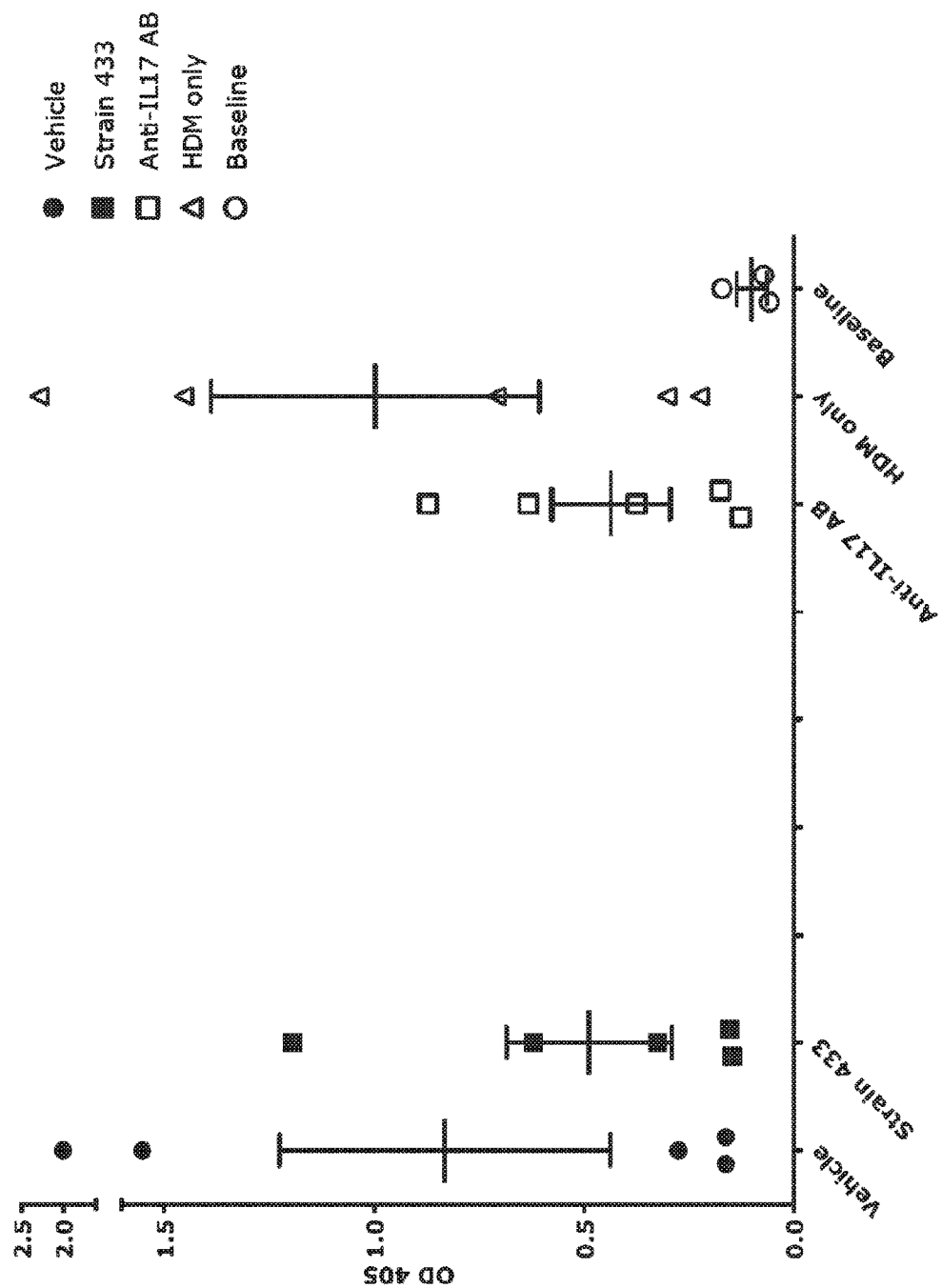
FIG. 46: Mouse model of severe neutrophilic asthma—HDM specific IgG1 in Serum
Figure 47:
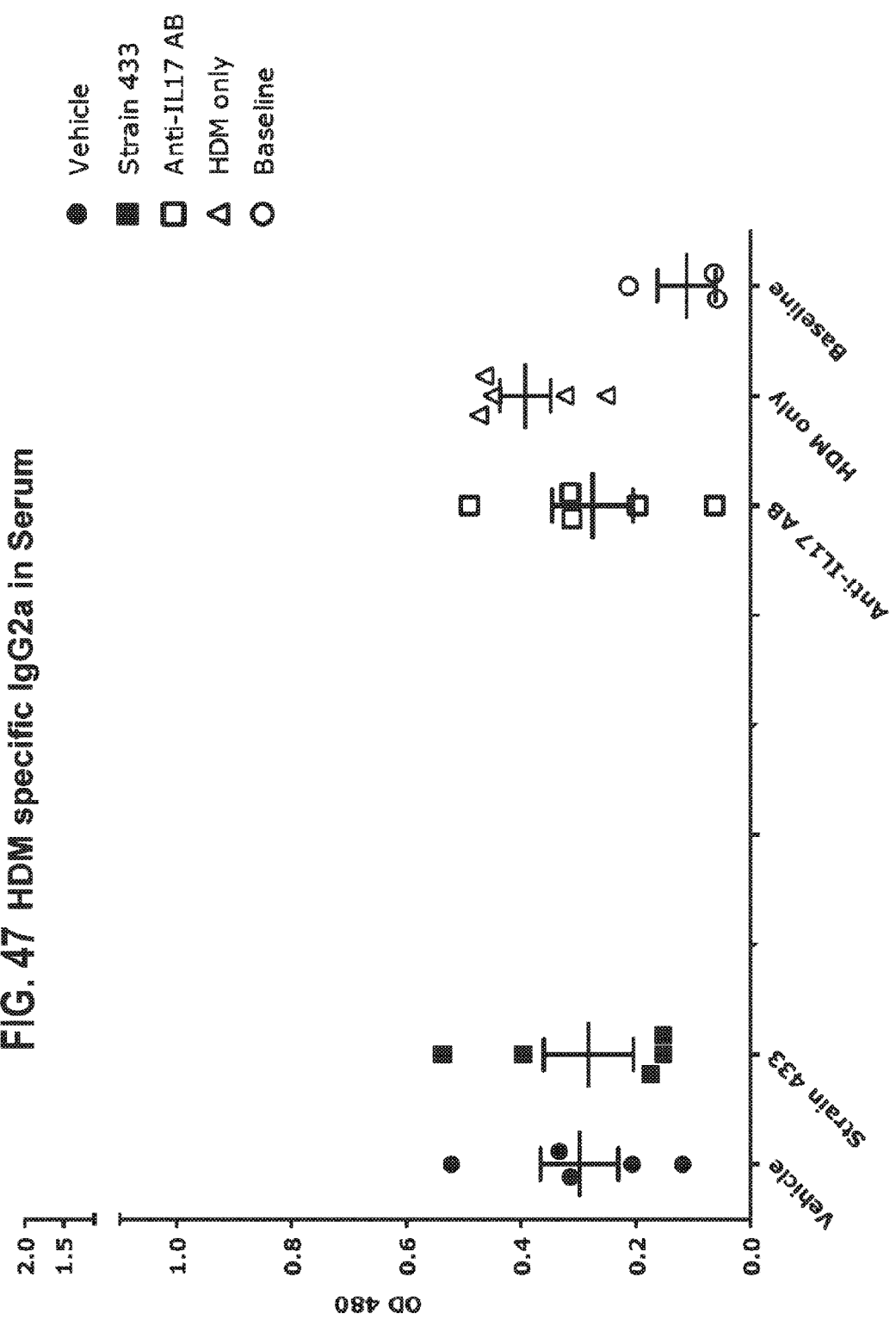
FIG. 47: Mouse model of severe neutrophilic asthma—HDM specific IgG2a in Serum
Figure 48:
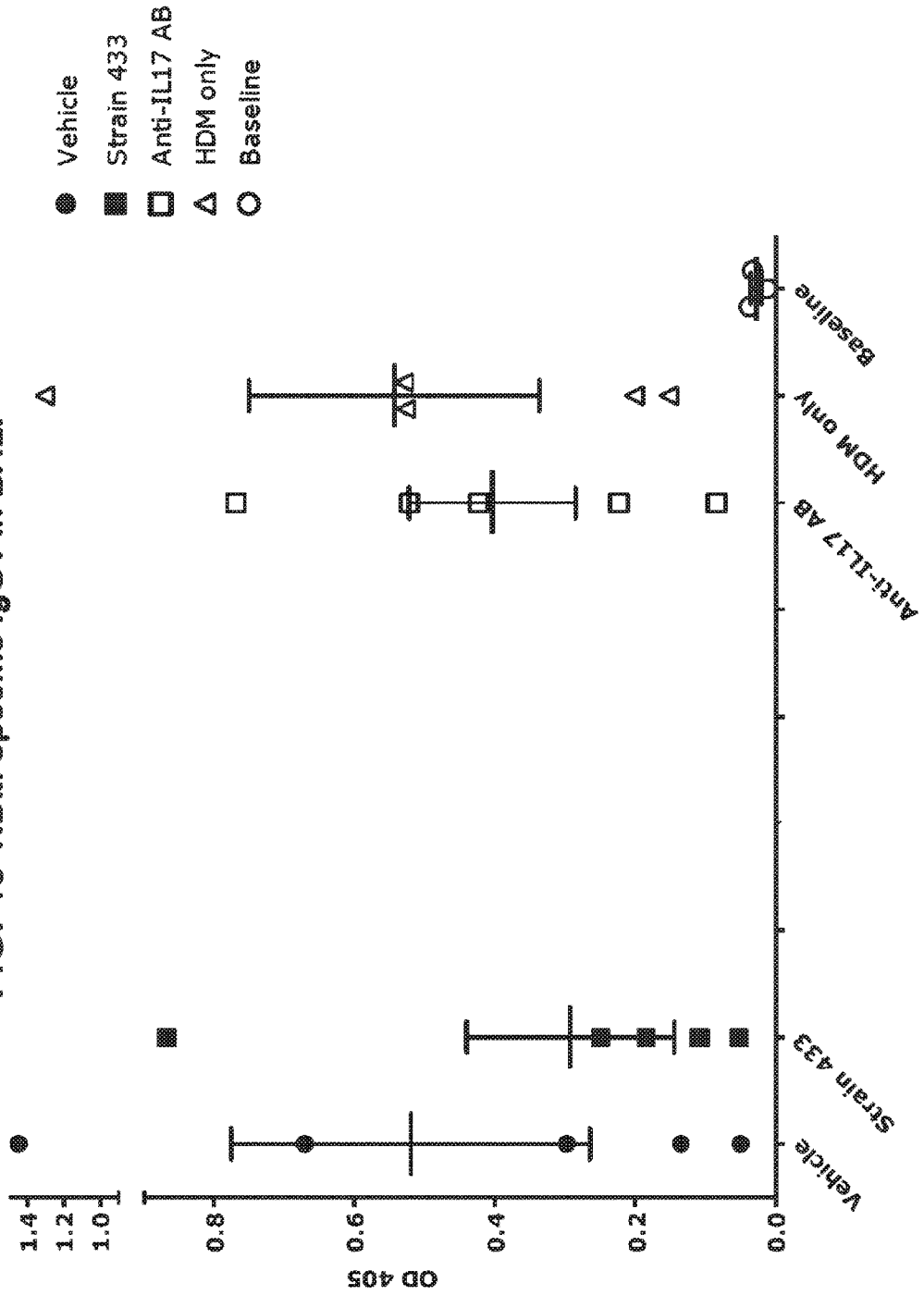
FIG. 48: Mouse model of severe neutrophilic asthma—HDM specific IgG1 in BALF
Figure 49:
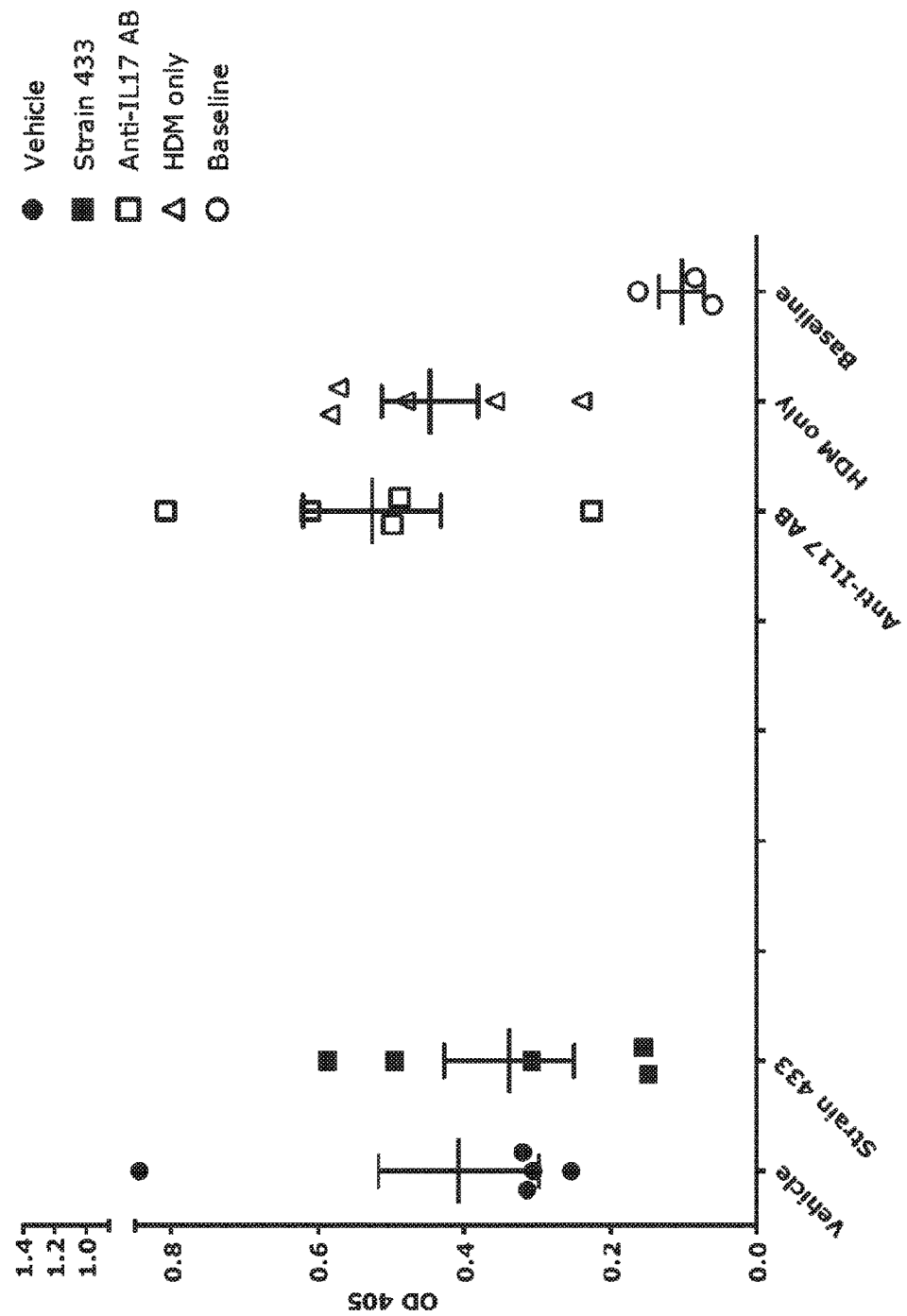
FIG. 49: Mouse model of severe neutrophilic asthma—HDM specific IgG2a in BALF
Figure 50:
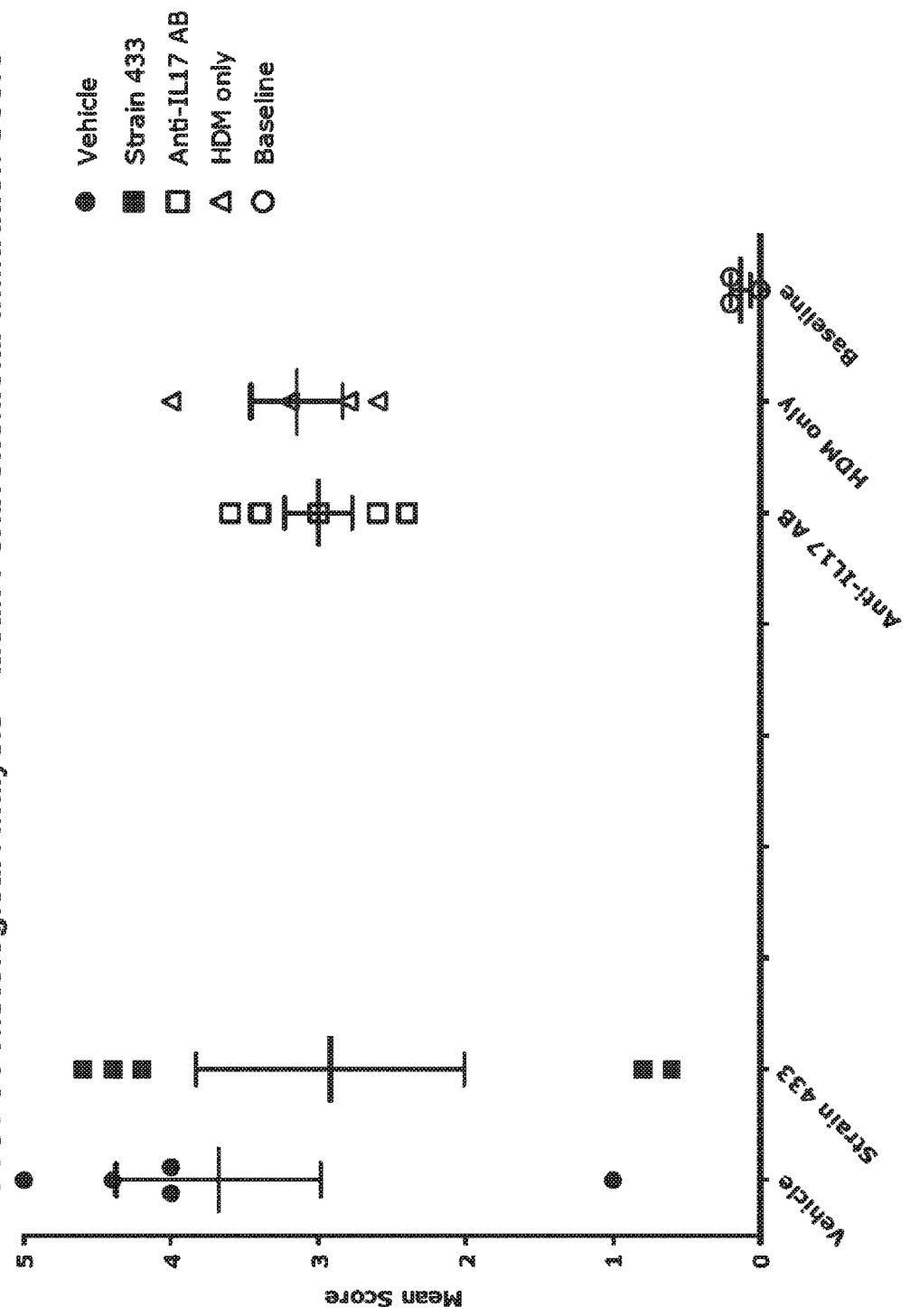
FIG. 50: Mouse model of severe neutrophilic asthma—Histological Analysis—Mean Peribronchiolar Infiltration Score
Figure 51:
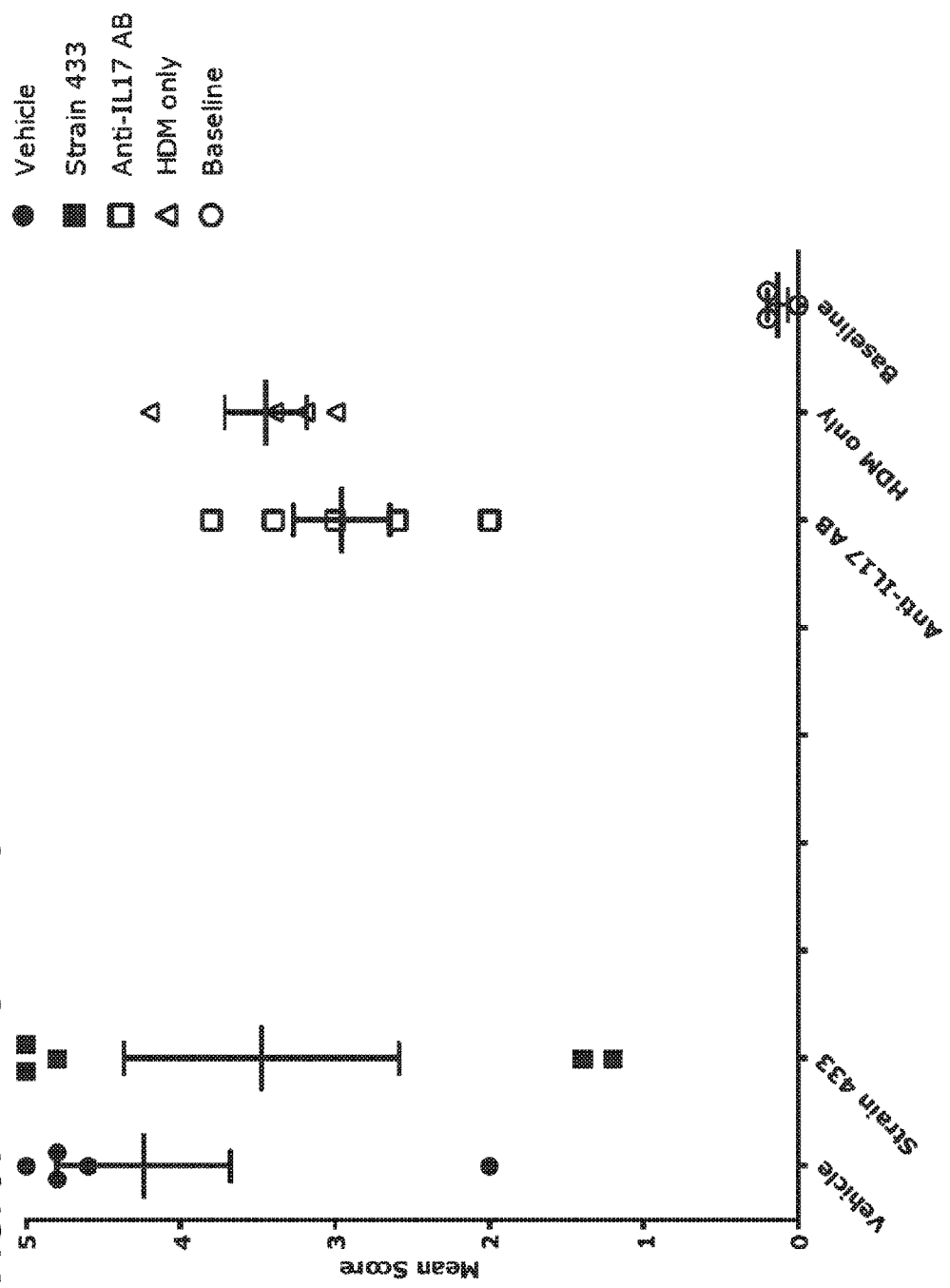
FIG. 51: Mouse model of severe neutrophilic asthma—Histological Analysis—Mean Perivascular Infiltration Score
Figure 52:
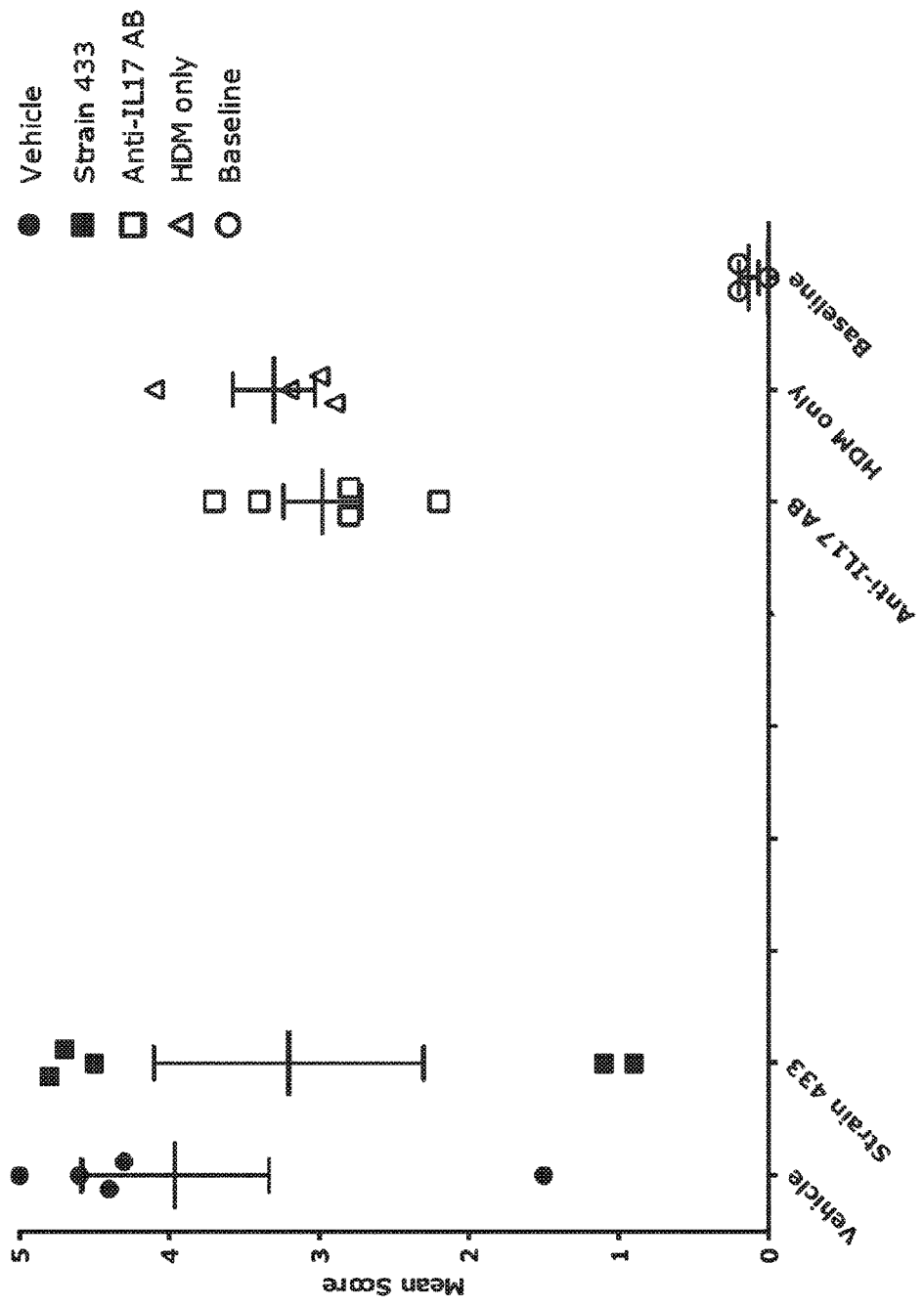
FIG. 52: Mouse model of severe neutrophilic asthma—Histological Analysis—Mean Inflammatory Score (Average of both Peribronchiolar and Perivascular Infiltration Score)
Figure 53:
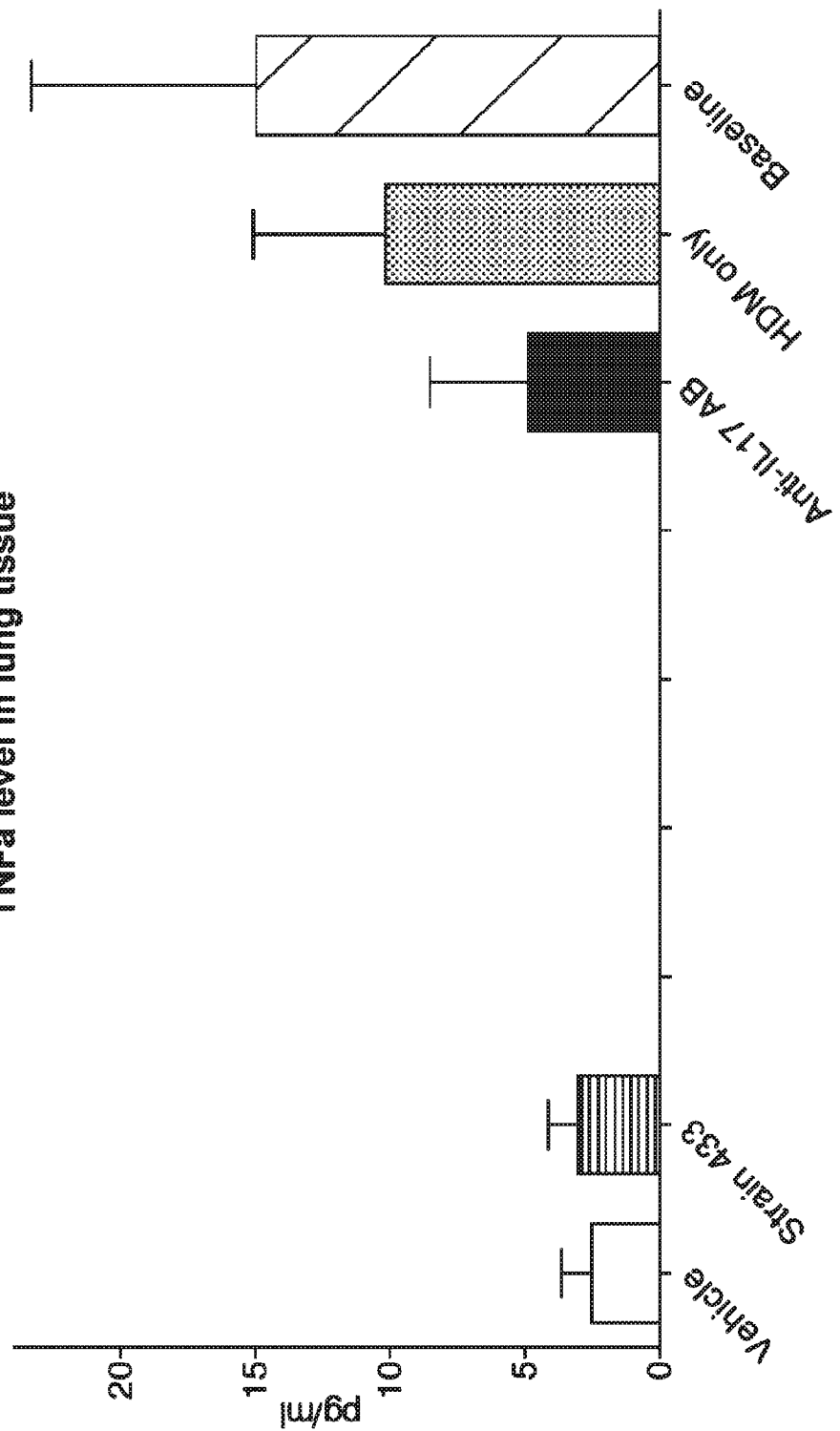
FIG. 53: Mouse model of severe neutrophilic asthma—TNFα level in lung tissue
Figure 54:
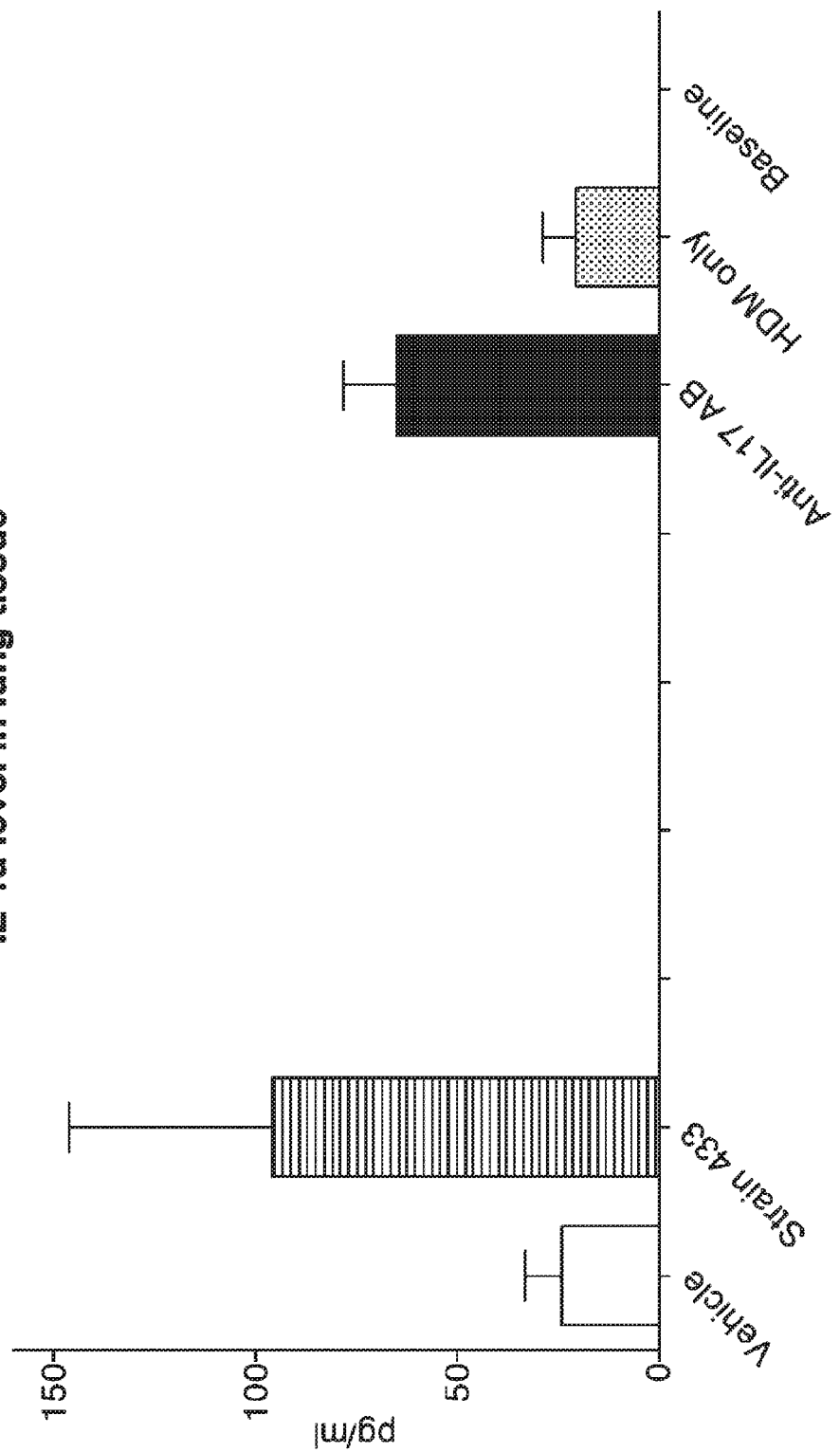
FIG. 54: Mouse model of severe neutrophilic asthma—IL-1a level in lung tissue

Further analysis of antibody levels revealed that the efficacy of bacterial strain 433 was also reflected in reduced HDM-specific IgG1 levels in the BAL fluid and serum (see FIGS. 46 and 48). Firm conclusions regarding an effect on IgG2a levels cannot be drawn. Overall, the data from the antibody analysis is suggestive of a reduction related to an overall reduced inflammatory response, as opposed to a selective effect on antibody isotype switching.

In relation to cytokine levels, as for Example 4, the spread of data and the error bars for each treatment are large, and the positive and negative controls do not appear to have behaved as necessarily would be expected. It is also possible that the mechanism of action involves influencing earlier cytokine responses that were no longer detectable on day 4 post the final HDM airway challenge. Some care should be taken when interpreting the cytokine data in the current study, due to the variability in the levels detected. This variability could in part be explained by the fact that the lung tissue was separated for the different analyses, and thus one lung lobe might not have been fully representative or comparable to the same lobe in other mice due to patchy distribution of the inflammation. Despite this variability, a clear anti-inflammatory effect on cytokine levels for strain 433 was shown, and the positive control anti-IL-17 Ab generally behaved as expected.

Figure 55:
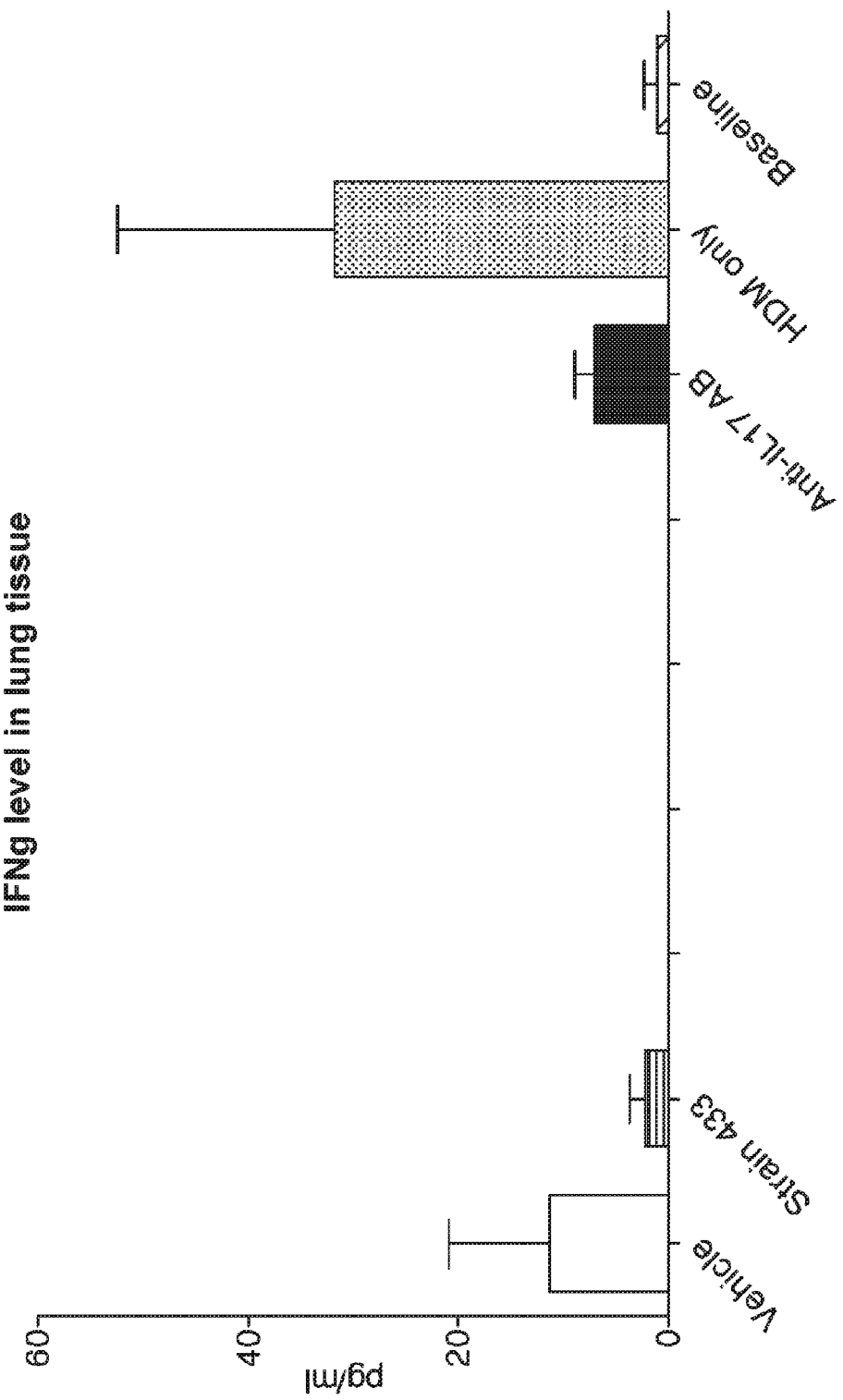
FIG. 55: Mouse model of severe neutrophilic asthma—IFNγ level in lung tissue
Figure 56:
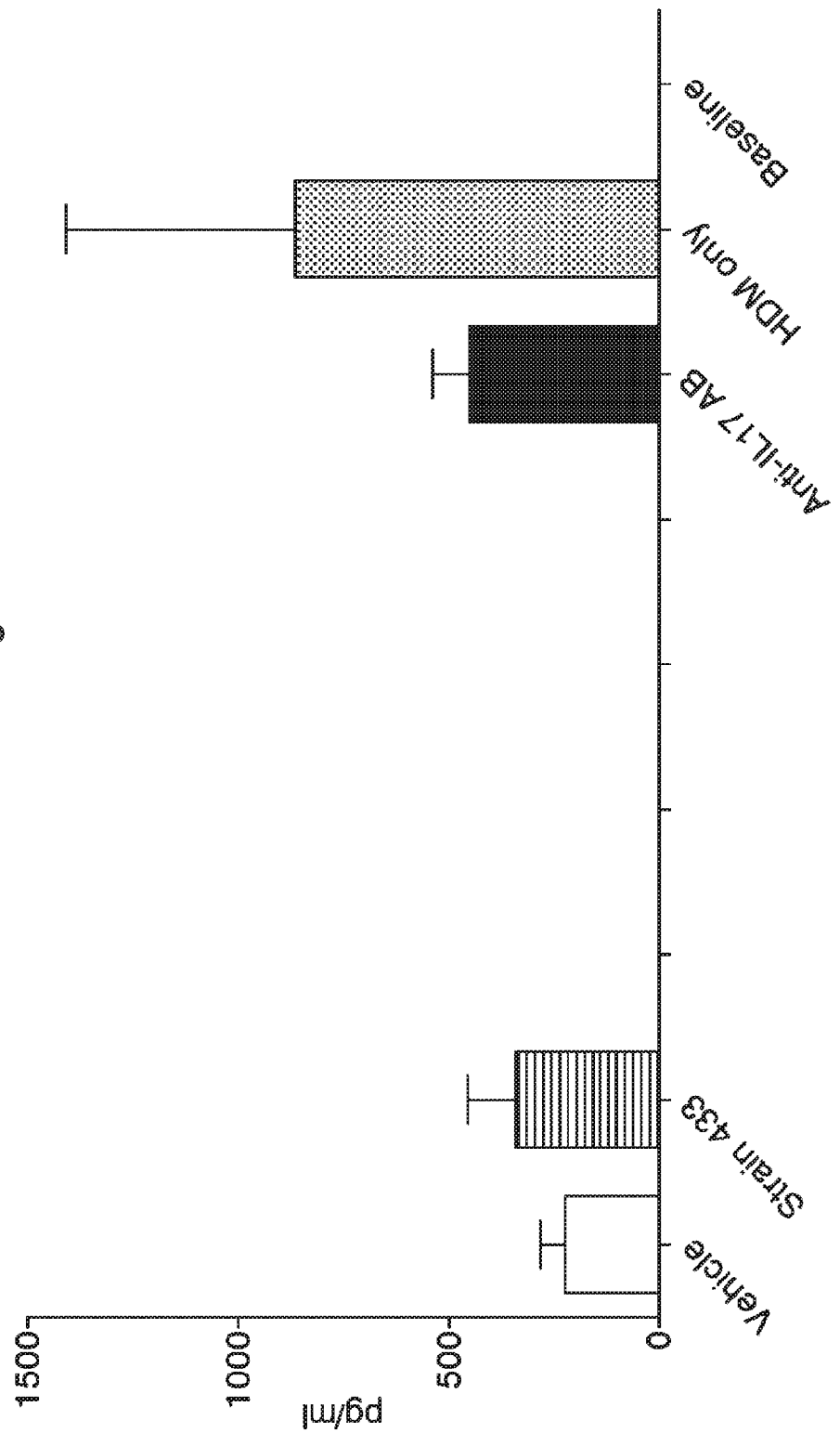
FIG. 56: Mouse model of severe neutrophilic asthma—IL-17F level in lung tissue
Figure 57:
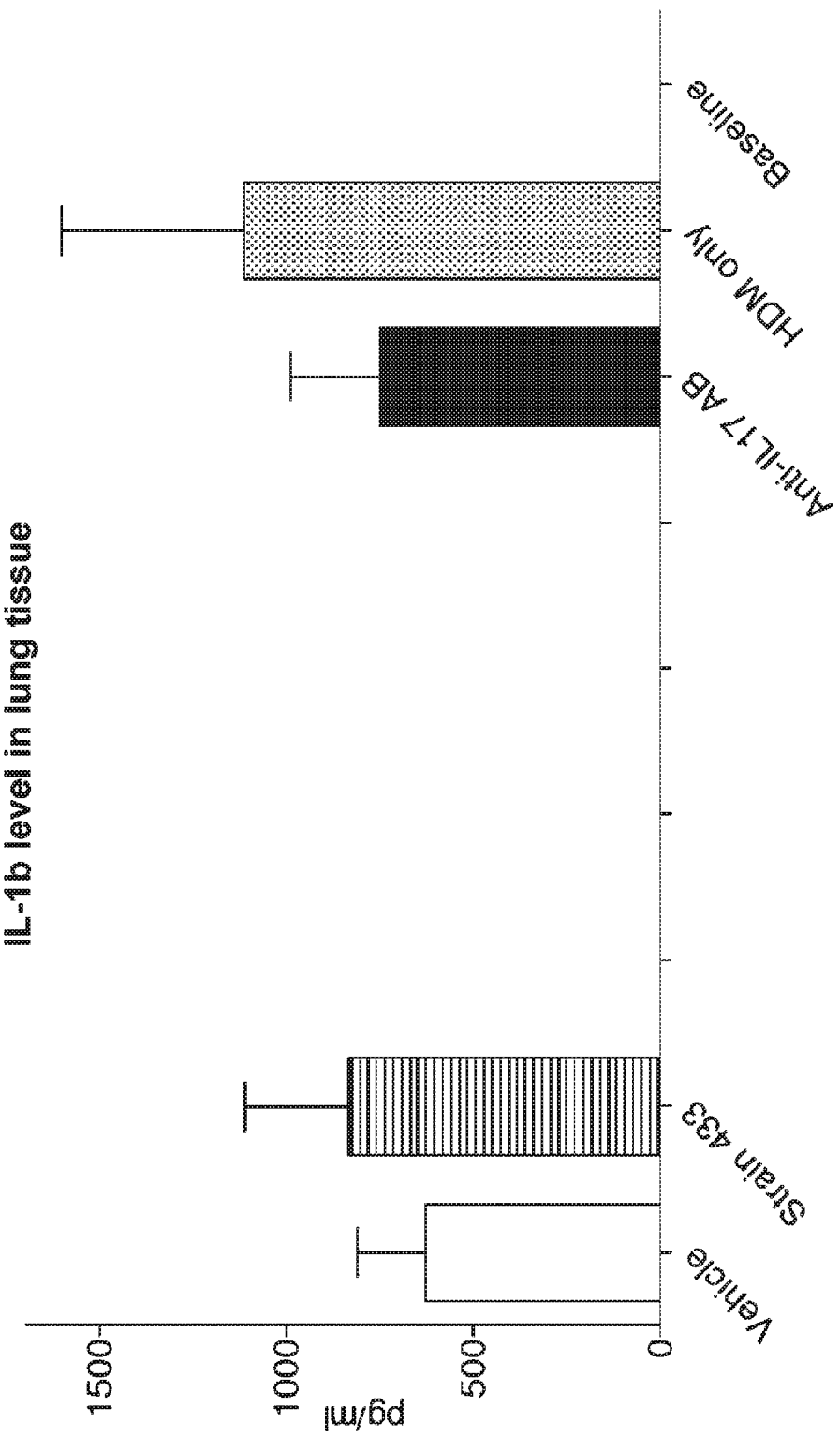
FIG. 57: Mouse model of severe neutrophilic asthma—IL-1b level in lung tissue
Figure 58:
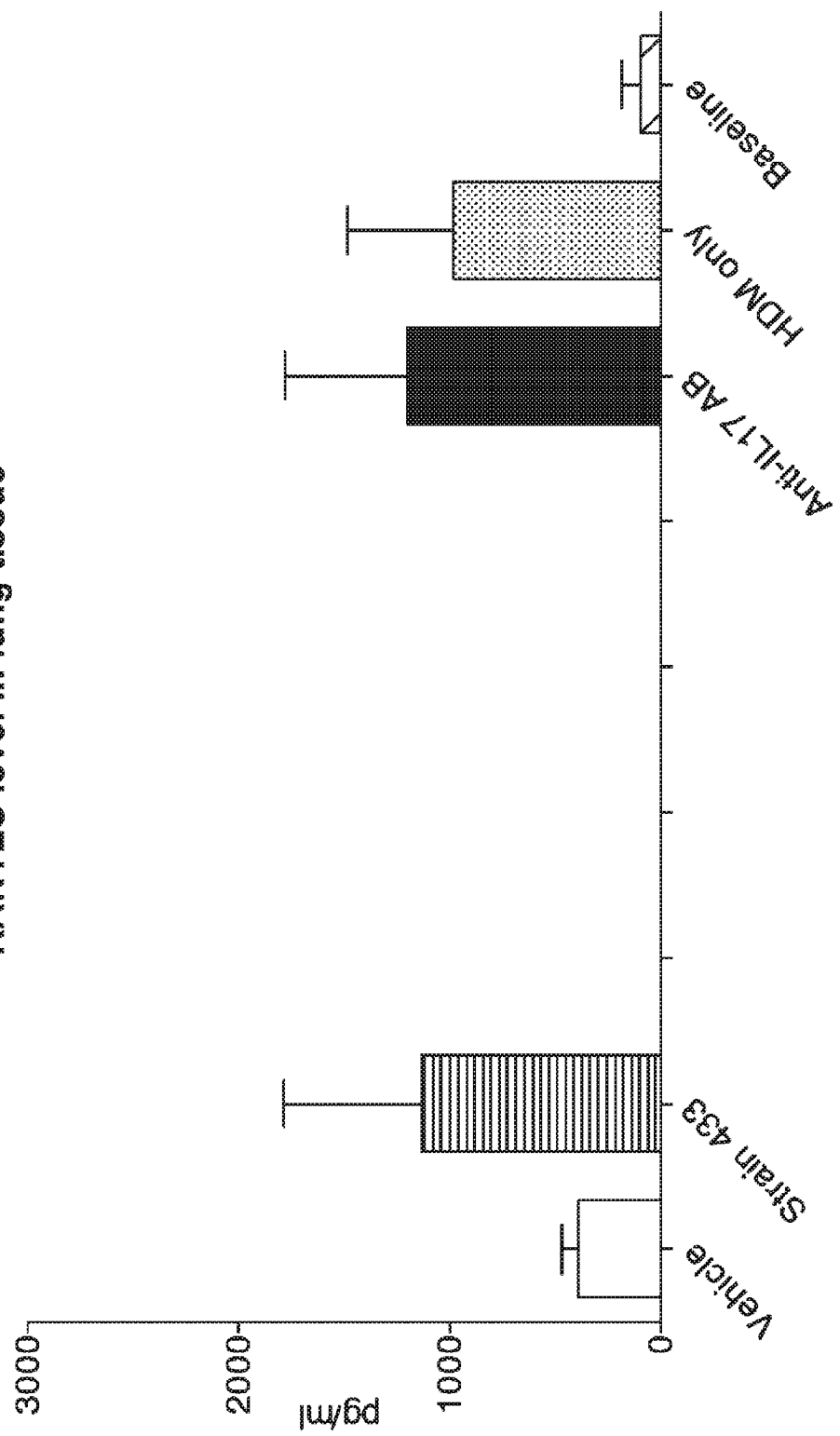
FIG. 58: Mouse model of severe neutrophilic asthma—RANTES level in lung tissue
Figure 59:
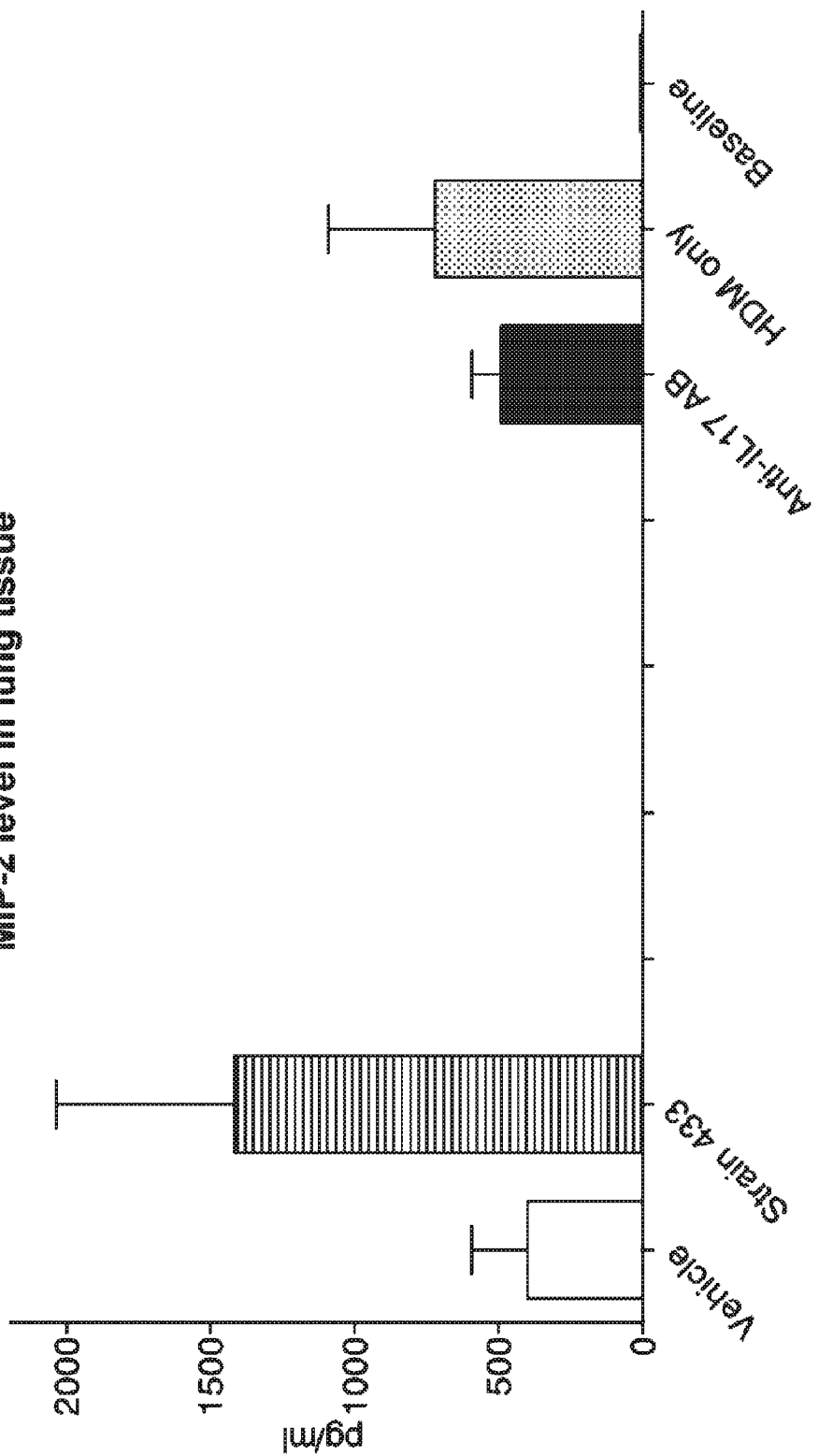
FIG. 59: Mouse model of severe neutrophilic asthma—MIP-2 level in lung tissue
Figure 60:
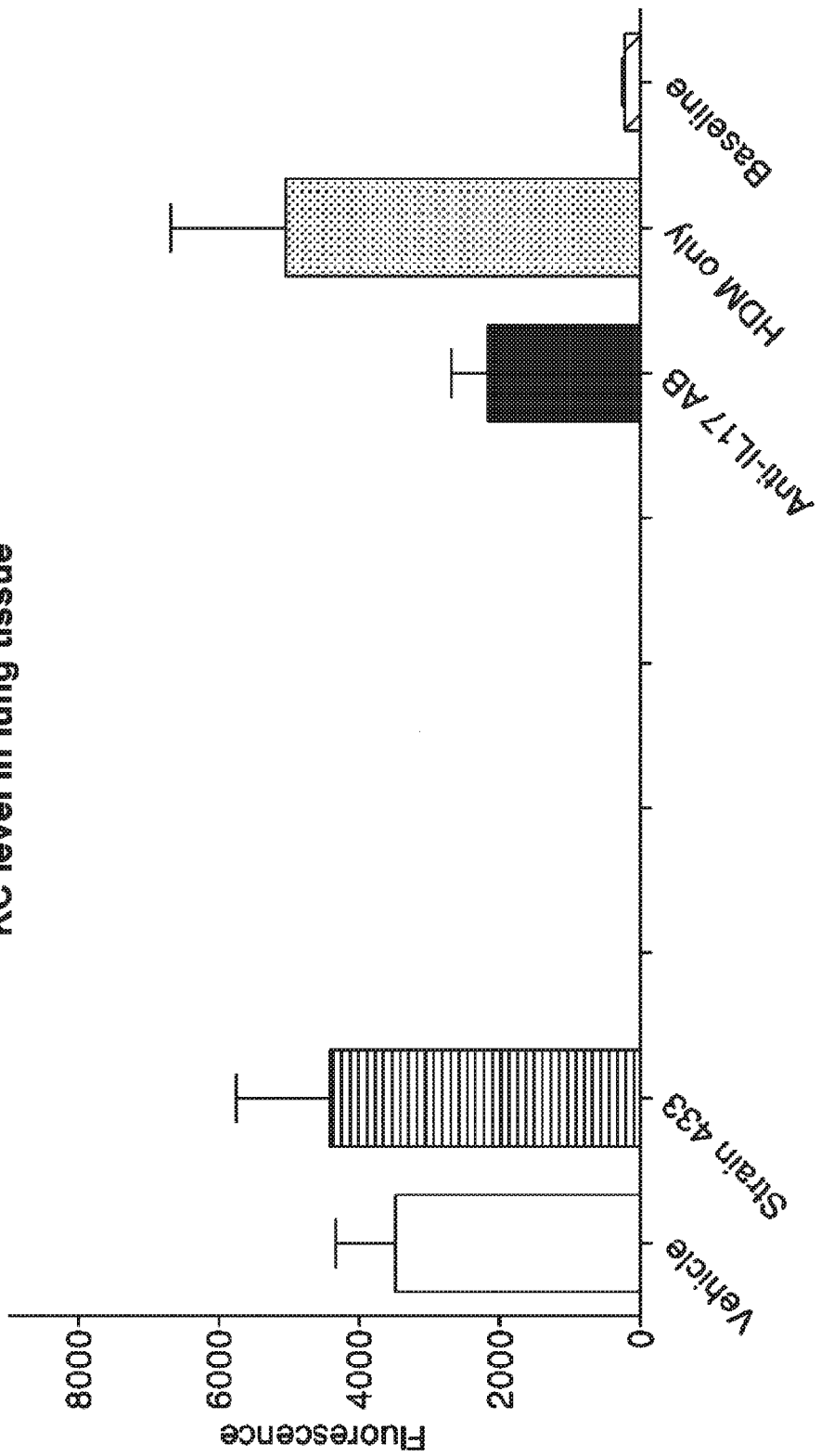
FIG. 60: Mouse model of severe neutrophilic asthma—KC level in lung tissue
Figure 61:
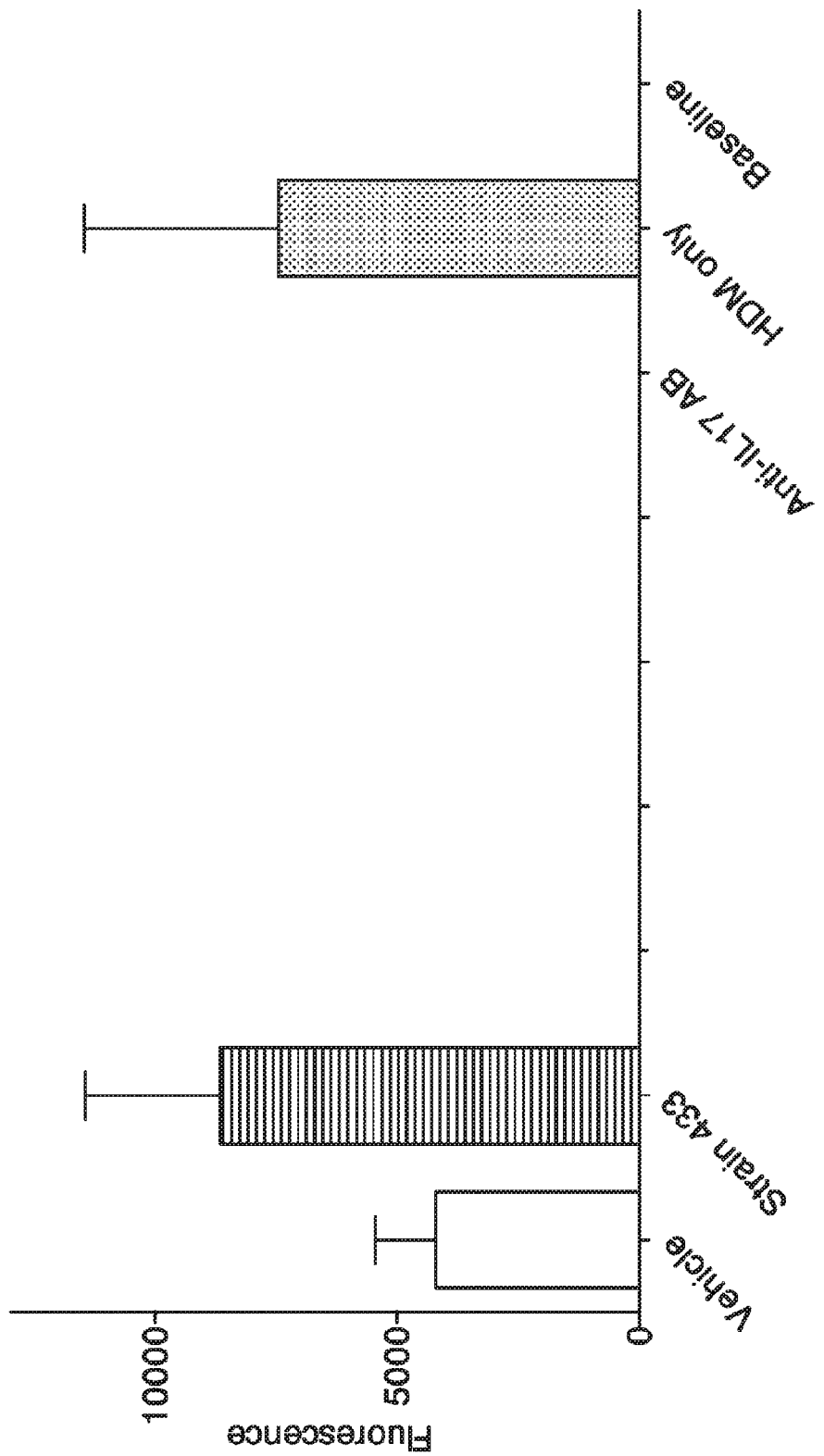
FIG. 61: Mouse model of severe neutrophilic asthma—IL-17A level in lung tissue
Figure 62:
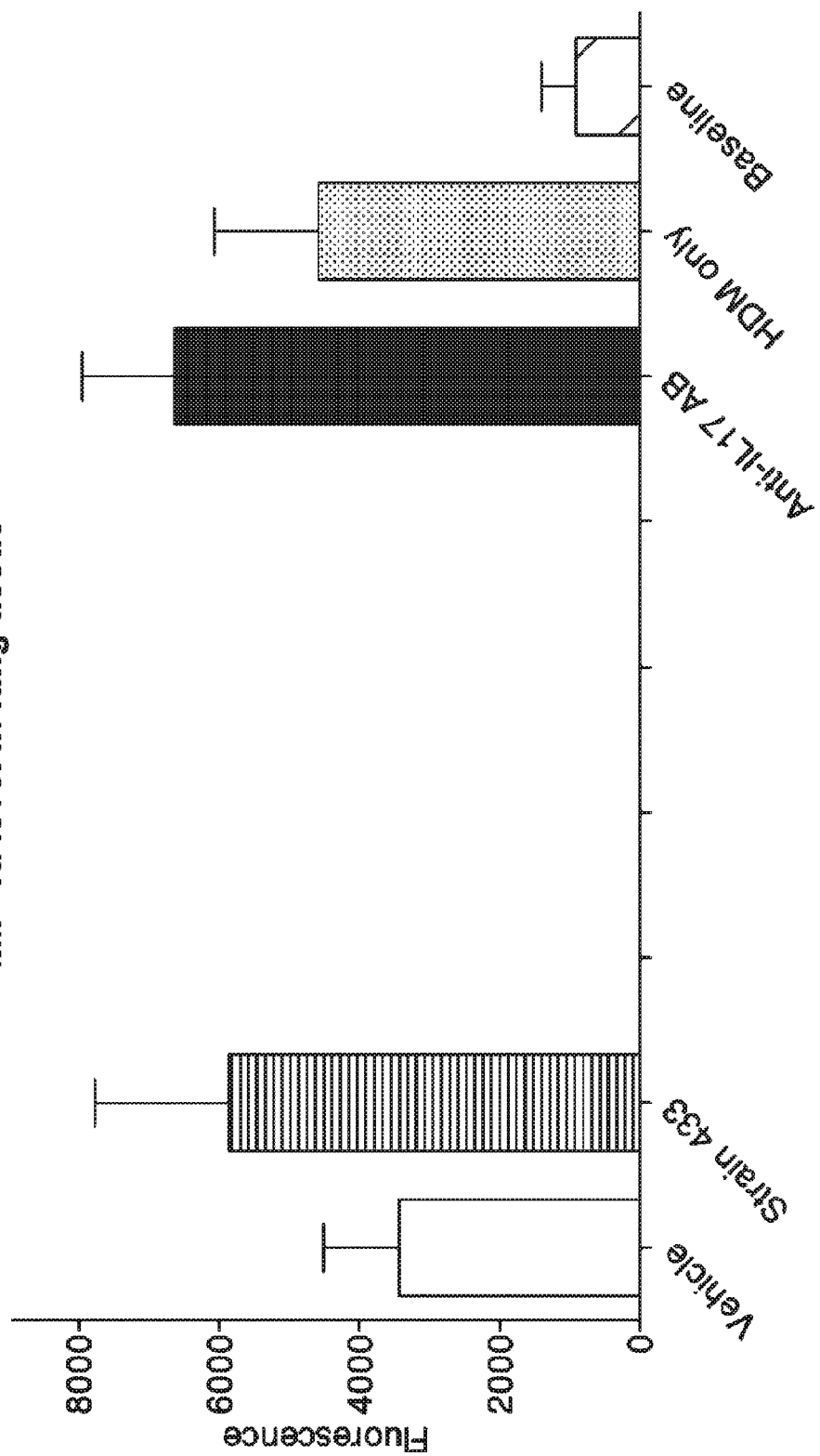
FIG. 62: Mouse model of severe neutrophilic asthma—MIP-1a level in lung tissue
Figure 63:
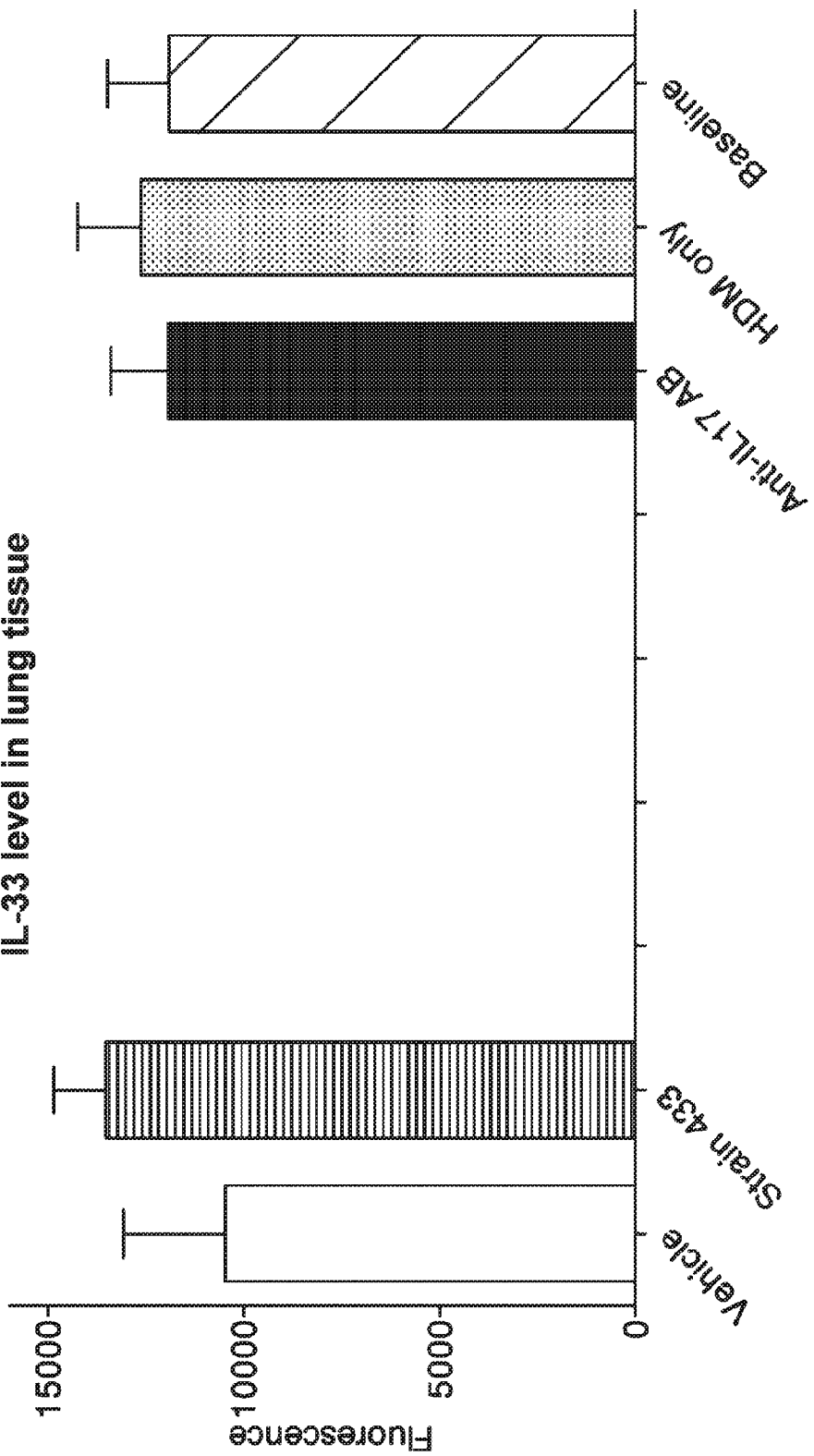
FIG. 63: Mouse model of severe neutrophilic asthma—IL-33 level in lung tissue
Figure 65:
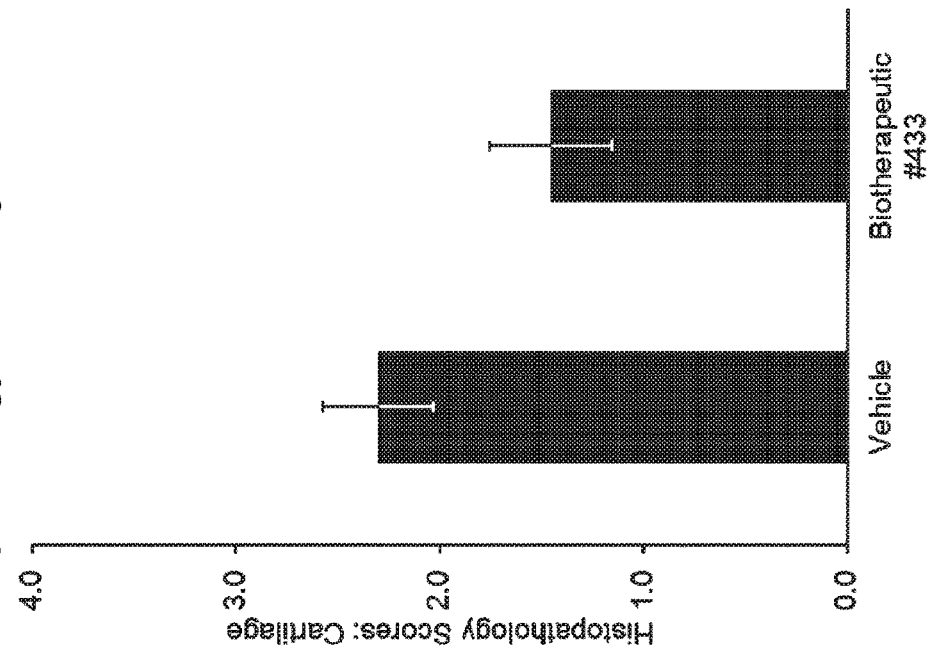
FIG. 65: Mouse model of rheumatoid arthritis—Histopathology: Inflammation Scores. Data are presented as Mean±SEM.
Figure 66:
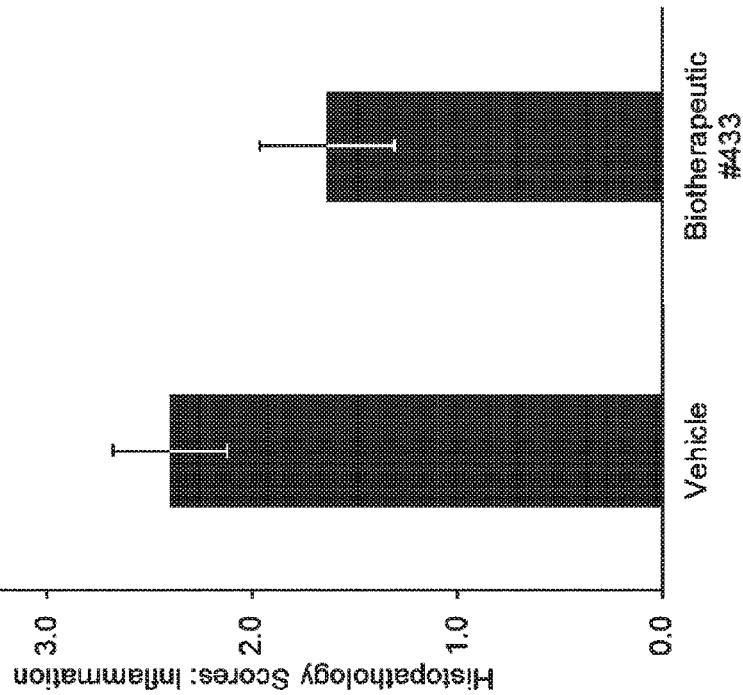
FIG. 66: Mouse model of rheumatoid arthritis—Histopathology: Cartilage Scores. Data are presented as Mean±SEM.
Figure 68:
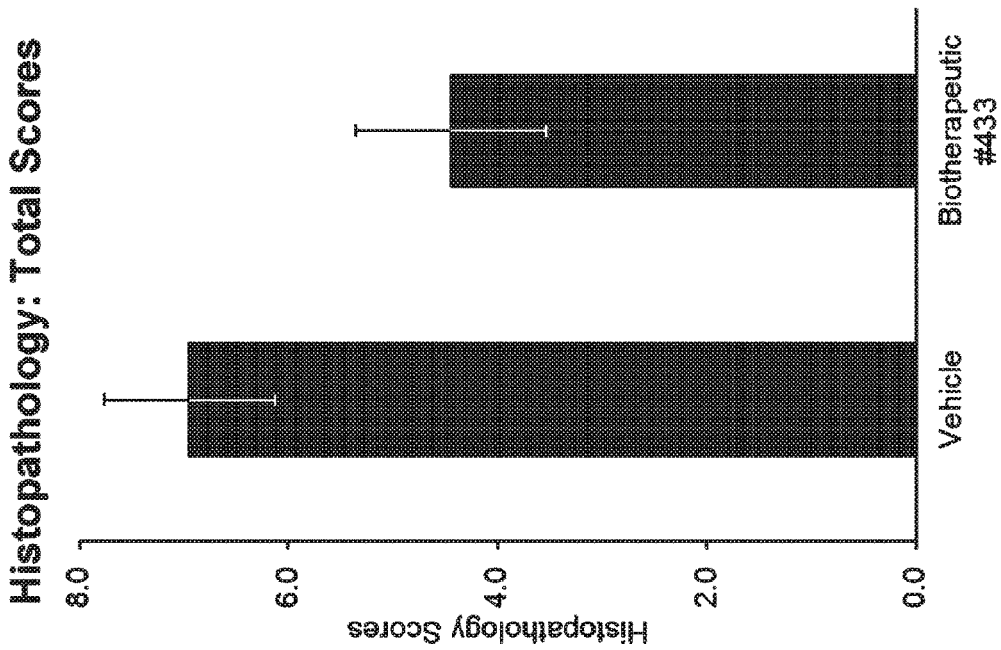
FIG. 68: Mouse model of rheumatoid arthritis—Histopathology: Total Scores. Data are presented as Mean±SEM.
Figure 67:
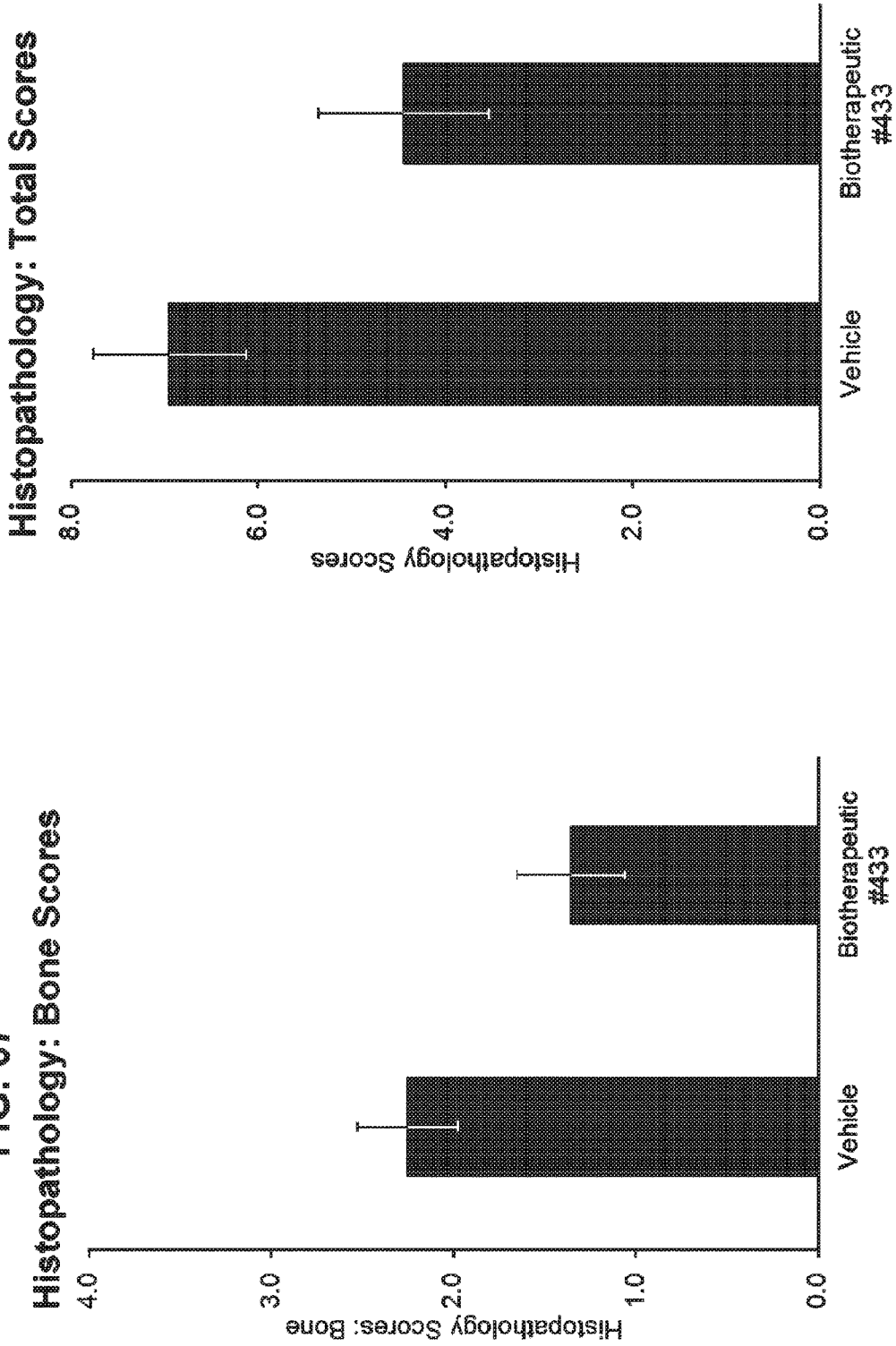
FIG. 67: Mouse model of rheumatoid arthritis—Histopathology: Bone Scores. Data are presented as Mean±SEM.

With the above caveats, the data in FIG. 55 suggests that treatment with strain 433 may achieve a reduction in the levels of IFNγ, which may be indicative of a mechanism of action related to influences on chemokine release (and thus recruitment of cells) by stromal or innate immune cells. IFNγ is involved in the Th17 pathway. Taking this dataset together, a clear conclusion can be drawn that strains 433 was effective at protecting mice against inflammation in this mouse model of severe neutrophilic asthma.

Example 6

Efficacy of Bacterial Inocula in a Mouse Model of Multiple Sclerosis

Summary

Mice were administered with compositions comprising bacterial strains according to the invention and the mice were subsequently immunised with myelin oligodendrocyte glycoprotein to induce experimental autoimmune encephalomyelitis (EAE). EAE is the most commonly used experimental model for human multiple sclerosis. The compositions of the invention were found to have a striking effect on disease incidence and disease severity.

Strain

433: bacteria deposited under accession number NCIMB 43283

Study Design

Groups:
1. Negative control group. Treatment with vehicle control (per oral).
5. Treatment with therapeutic bacteria inoculum strain 433 (per oral).
9. Positive control group. Treatment with Dexamethasone (i.p.).
10. Untreated Control Group.

Number of mice per group=10

Days −14 to day 27: Daily administration of vehicle control per oral (Group 1).

Days −14 to day 27: Daily administration of therapeutic bacteria inoculum per oral (Group 5).

Days 0-28: administration of Dexamethasone (i.p.) three times a week (Group 9)

Day 0: MOG35-55 (myelin oligodendrocyte glycoprotein—2 mg/ml) and CFA (2 mg/ml MTB) were mixed 1:1 resulting in 1 mg/ml solutions. 100 µl of the peptide-CFA mixture was injected subcutaneously into each hind leg. Administration of pertussis toxin intraperitoneally (300 ng).

Day 1: Administration of pertussis toxin intraperitoneally (300 ng).

Days 7-onwards: Measurement of disease incidence and weight three times a week.

Endpoints and Analysis

Mice were analysed for disease incidence and disease severity three times a week. Scoring was performed blind. Disease severity was assessed using a clinical score ranging from 0 to 5, with 5 indicating a dead mouse (see clinical scoring system below).

Monitoring

On the indicated days mice were weighed and observed for disease activity score and disease incidence.

Disease Activity Score Observations:
0—No obvious changes in motor function compared to non-immunized mice.
0.5—Tip of tail is limp.
1.0—Limp tail.
1.5—Limp tail and hind leg inhibition.
2.0—Limp tail and weakness of hind legs.
  OR—There are obvious signs of head tilting when the walk is observed. The balance is poor.
2.5—Limp tail and dragging of hind legs.
  OR—There is a strong head tilt that causes the mouse to occasionally fall over.
3.0—Limp tail and complete paralysis of hind legs.
3.5—Limp tail and complete paralysis of hind legs.
  In addition to: Mouse is moving around the cage, but when placed on its side, is unable to right itself.
  Hind legs are together on one side of body.
4.0—Limp tail, complete hind leg and partial front leg paralysis.
  Mouse is minimally moving around the cage but appears alert and feeding
4.5—Complete hind and partial front leg paralysis, no movement around the cage.
  Mouse is immediately euthanized and removed from cage.
5.0 Mouse is euthanized due to severe paralysis.

When an animal has equal or greater disease activity score of 1, it is considered to have a positive disease incidence score.

Results

Figure 70:
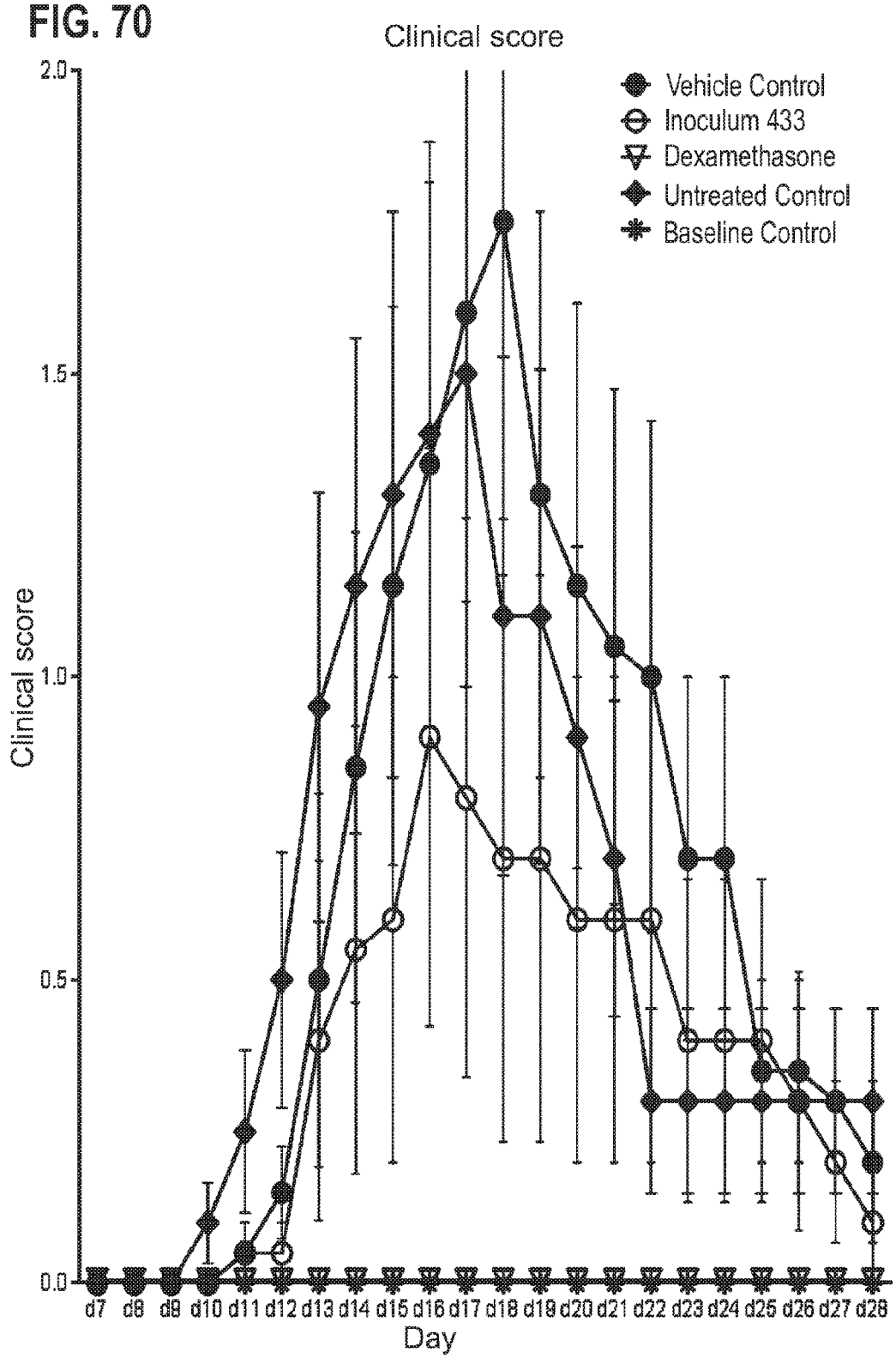
FIG. 70: Mouse model of multiple sclerosis—clinical score.

The results of the study are shown in FIGS. 70 and 71.

Disease induction in the negative control groups was successful with high scores shown by the vehicle control and the untreated control. The effect of treatment with strain 433 was striking and the mice treated with strain 433 exhibited notably reduced disease incidence and disease severity. These data indicate the strain 433 may be useful for treating or preventing multiple sclerosis.

Example 7

Stability Testing

A composition described herein containing at least one bacterial strain described herein is stored in a sealed container at 25° C. or 4° C. and the container is placed in an atmosphere having 30%, 40%, 50%, 60%, 70%, 75%, 80%, 90% or 95% relative humidity. After 1 month, 2 months, 3 months, 6 months, 1 year, 1.5 years, 2 years, 2.5 years or 3 years, at least 50%, 60%, 70%, 80% or 90% of the bacterial strain shall remain as measured in colony forming units determined by standard protocols.

Sequences

SEQ ID NO: 1 (*Roseburia hominis* strain A2-181 16S ribosomal RNA gene, partial sequence-AY804148)

```
  1 taaaggttga tcctggctca ggatgaacgc tggaggcgtg cttaacacat gcaagtcgaa
 61 cgaagcactt taattgattt cttcggaatg aagttttgt gactgagtgg cggacgggtg
121 agtaacgcgt gggtaacctc gctcatacag ggggataaca gttggaaacg actgctaata
181 ccgcataagc gcacaggatt gcatgatcca gtgtgaaaaa ctccggtggt atgagatgga
241 cccgcgtctg attagccagt tggcggggta acggcccacc aaagcgacga tcagtagccg
301 acctgagagg gtgaccggcc acattgggac tgagacacgg cccaaactcc tacgggaggc
361 agcagtgggg aatattgcac aatgggggaa accctgatgc agcgacgccg agtgagcgaa
421 gaagtatttc ggtatgtaaa gctctatcag caggaagaag aatgacggta cctgactaaa
481 aagcaccggc taaatacgtg ccagcagccg cggtaatacg tatggtgcaa gcgttatccg
541 gatttactgg gtgtaaaggg agcgcaggcg gtacggcaag tctgatgtga aatcccgggg
601 ctcaaccccg gtactgcatt ggaaactgtc ggactagggt gtctgagggg taagtggaat
661 tcctagtgta gcggtgaaat gcgtagatat taggaggaac accagtggcg aaggcggctt
721 actggacgat tactgacgct gaggctcgaa agcgtgggga gcaaacagga ttagataccc
781 tggtagtcca cgccgtaaac gatgaatact aggtgtcggg gagcattgct cttcggtgcc
841 gcagcaaacg caataagtat tccacctggg gagtacgttc gcaagaatga aactcaaagg
901 aattgacggg gacccgcaca agcggtggag catgtggttt aattcgaagc aacgcgaaga
961 accttaccaa gtcttgacat cccactgaca aagtatgtaa tgtactttct cttcggagca
```

-continued

```
Sequences
1021 gtggtgacag gtggtgcatg gttgtcgtca gctcgtgtcg tgagatgttg ggttaagtcc
1081 cgcaacgagc gcaacccta ttcttagtag ccagcggttt ggccgggcac tctagggaga
1141 ctgccaggga taacctggag gaaggtgggg atgacgtcaa atcatcatgc cccttatgac
1201 ttgggctaca cacgtgctac aatggcgtaa acaaagggaa gcaatcccgc gaggggagc
1261 aaatctcaaa aataacgtct cagttcggac tgtagtctgc aactcgacta cacgaagctg
1321 gaatcgctag taatcgcgaa tcagaatgtc gcggtgaata cgttcccggg tcttgtacac
1381 accgcccgtc acaccatggg agttggtaat gcccgaagtc agtgacccaa ccgcaaggag
1441 ggagctgccg aagcaggact gataactggg gtgaagtcgt aacaagt
```

SEQ ID NO: 2 (*Roseburia hominis* A2-183 16S rRNA gene, type strain A2-183T-AJ270482)

```
   1 gatcctggct caggatgaac gctggcggcg tgcttaacac atgcaagtcg aacgaagcac
  61 tttaattgat ttcttcggaa tgaagttttt gtgactgagt ggcggacggg tgagtaacgc
 121 gtgggtaacc tgcctcatac aggggataaa cagttggaaa cgactgctaa taccgcataa
 181 gcgcacagga ttgcatgatc cagtgtgaaa aactccggtg gtatgagatg gacccgcgtc
 241 tgattagcca gttggcgggg taacggccca ccaaagcgac gatcagtagc cgacctgaga
 301 gggtgaccgg ccacattggg actgagacac ggcccaaact cctacgggag gcagcagtgg
 361 ggaatattgc acaatggggg aaaccctgat gcagcgacgc cgcgtgagcg aagaagtatt
 421 tcggtatgta aagctctatc agcagggaag aagaatgcgg tacctgacta agaagcaccg
 481 gctaaatacg tgccagcagc cgcggtaata cgtatggtgc aagcgttatc cggatttact
 541 gggtgtaaag ggagcgcagg cggtacggca agtctgatgt gaaatcccgg ggctcaaccc
 601 cggtactgca ttgaaactg tcggactaga gtgtcgaggg ggtaagtgga attcctagtg
 661 tagcggtgaa atgcgtagat attaggagga acaccagtgg cgaaggcggc ttactggacg
 721 attactgacg ctgaggctcg aaagcgtggg gagcaaacag gattagatac cctggtagtc
 781 cacgccgtaa acgatgaata ctaggtgtcg gggagcattg ctcttcggtg ccgcagcaaa
 841 cgcaataagt attccacctg gggagtacgt tcgcaagaat gaaactcaaa ggaattgacg
 901 gggacccgca caagcggtgg agcatgtggt ttaattcgaa gcaacgcgaa gaaccttacc
 961 aagtcttgac atcccactga cagagtatgt aatgtacttt ctcttcggag cagtggtgac
1021 aggtggtgca tggttgtcgt cagctcgtgt cgtgagatgt tgggttaagt cccgcaacga
1081 gcgcaaccc tattcttagt agccagcggt tcggccgggc actctaggga gactgccagg
1141 gataacctgg aggaaggtgg ggatgacgtc aaatcatcat gccccttatg acttgggcta
1201 cacacgtgct acaatggcgt aaacaaaggg aagcaatccc gcgaggggga gcaaatctca
1261 aaaataacgt ctcagttcgg actgtagtct gcaactcgac tacacgaagc tggaatcgct
1321 agtaatcgcg aatcagaatg tcgcggtgaa tacgttcccg ggtcttgtac acaccgcccg
1381 tcacaccatg ggagttggta atgcccgaag tcagtgaccc aaccgcaagg agggagctgc
1441 cgaaggcagg actgataact ggggtgaagt cgtaacaagg tacg
```

SEQ ID NO: 3 (consensus 16S rRNA sequence for *Roseburia hominis* strain 433)

```
AAGAGTTTGGGHCAGGCTCAGGATGAACGCTGGCGGCGTGCTTAACACATGCAAGTCGAACGAAGCACTT
TAATTGATTTCTTCGGAATGAAGTTTTTGTGACTGAGTGGCGGACGGGTGAGTAACGCGTGGGTAACCTG
CCTCATACAGGGGGATAACAGTTGGAAACGACTGCTAATACCGCATAAGCGCACAGGATTGCATGATCCA
GTGTGAAAAACTCCGGTGGTATGAGATGGACCCGCGTCTGATTAGCCAGTTGGCGGGGTAACGGCCCACC
AAAGCGACGATCAGTAGCCGACCTGAGAGGGTGACCGGCCACATTGGGACTGAGACACGGCCCAAACTCC
TACGGGAGGCAGCAGTGGGGAATATTGCACAATGGGGGAAACCCTGATGCAGCGACGCCGCGTGAGCGAA
GAAGTATTTCGGTATGTAAAGCTCTATCAGCAGGGAAGAAGAATGACGGTACCTGACTAAGAAGCACCGG
CTAAATACGTGCCAGCAGCCGCGGTAATACGTATGGTGCAAGCGTTATCCGGATTTACTGGGTGTAAAGG
GAGCGCAGGCGGTACGGCAAGTCTGATGTGAAATCCCGGGGCTCAACCCCGGTACTGCATTGGAAACTGT
CGGACTAGAGTGTCGGAGGGGTAAGTGGAATTCCTAGTGTAGCGGTGAAATGCGTAGATATTAGGAGGAA
CACCAGTGGCGAAGGCGGCTTACTGGACGATTACTGACGCTGAGGCTCGAAAGCGTGGGGAGCAAACAGG
ATTAGATACCCTGGTAGTCCACGCCGTAAACGATGAATACTAGGTGTCGGGGAGCATTGCTCTTCGGTGC
CGCAGCAAACGCAATAAGTATNCCACCTGGGGAGTACGTTCGCAAGAATGAAACTCAAAGGAATTGACGG
GGACCCGCACAAGCGGTGGAGCNTGTGGTTTAATTCGAAGCAACGCGAAGAACCTTACCAAGTCTTGACA
TCCCACTGACAGAGTATGTAATGTACTTTCTCTTCGGAGCAGTGGTGACAGGTGGTGCATGGTTGTCGTC
AGCTCGTGTCGTGAGATGTTGGGTTAAGTCCCGCAACGAGCGCAACCCCTATTCTTAGTAGCCAGCGGTT
TGGCCGGGCACTCTAGGGAGACTGCCAGGGATAACCTGGAGGAAGGTGGGGATGACGTCAAATCATCATG
CCCCTTATGACTTGGGCTACACACGTGCTACAATGGCGTAAACAAAGGGAAGCAATCCCGCGAGGGGGA
CAAATCTCAAAAATAACGTCTCAGTTCGGACTGTAGTCTGCAACTCGACTACACGAAGCTGGAATCGCTA
GTAATCGCGAATCAGAATGTCGCGGTGAATACGTTCCCGGGTCTTGTACACACCGCCCGTCACACCATGG
GAGTTGGTAATGCCCGAAGTCAGTGACCCAACCGCAAGGAGGGAGCTGCCGAAGGCAGGACTGATAACTG
GGGTGAAGTCTACRSAGGGTAGCCGTRMMC
```

SEQ ID NO: 4 (strain 433 genome sequence)-see electronic sequence listing.

REFERENCES

[1] Spor et al. (2011) *Nat Rev Microbiol.* 9(4):279-90.
[2] Eckburg et al. (2005) *Science.* 10; 308(5728):1635-8.
[3] Macpherson et al. (2001) *Microbes Infect.* 3(12):1021-35
[4] Macpherson et al. (2002) *Cell Mol Life Sci.* 59(12):2088-96.
[5] Mazmanian et al. (2005) *Cell* 15; 122(1):107-18.
[6] Frank et al. (2007) *PNAS* 104(34):13780-5.
[7] Scanlan et al. (2006) *J Clin Microbiol.* 44(11):3980-8.
[8] Kang et al. (2010) *Inflamm Bowel Dis.* 16(12):2034-42.
[9] Machiels et al. (2013) *Gut.* 63(8):1275-83.
[10] WO 2013/050792
[11] WO 03/046580
[12] WO 2013/008039
[13] WO 2014/167338
[14] Goldin and Gorbach (2008) *Clin Infect Dis.* 46 Suppl 2:S96-100.
[15] Azad et al. (2013) *BMJ.* 347:f6471.
[16] Stanton and Savage (1983) *Appl Environ Microbiol.* 45(5):1677-84

[17] Duncan et al. (2006) *Int. J. Syst. Evol. Microbiol.* 56: 2437-2441
[18] Masco et al. (2003) *Systematic and Applied Microbiology,* 26:557-563.
[19] Srfitkova et al. (2011) *J. Microbiol. Methods,* 87(1): 10-6.
[20] Ye et al. (2015) *PLoS One.* 10(1):e0117704.
[21] Fabro et al. (2015) *Immunobiology.* 220(1): 124-35.
[22] Yin et al. (2014) *Immunogenetics.* 66(3):215-8.
[23] Cheluvappa et al. (2014) *Clin Exp Immunol.* 175(2): 316-22.
[24] Schieck et al. (2014) *J Allergy Clin Immunol.* 133(3): 888-91.
[25] Balato et al. (2014) *J Eur Acad Dermatol Venereol.* 28(8):1016-24.
[26] Monteleone et al. (2011) *BMC Medicine.* 2011, 9:122.
[27] Fahy (2009) *Proc Am Thorac Soc* 6.256-259
[28] Miossec and Kolls (2012) *Nat Rev Drug Discov.* 11(10):763-76.
[29] Yang et al. (2014) *Trends Pharmacol Sci.* 35(10):493-500.
[30] Koenders et al. (2006) *J. Immunol.* 176:6262-6269.
[31] Amedei et al. (2012) *Int J Mol Sci.* 13(10):13438-60.
[32] Shabgah et al. (2014) *Postepy. Dermatol. Alergol.* 31(4):256-61.
[33] Miyamoto-Shinohara et al. (2008) *J. Gen. Appl. Microbiol.,* 54, 9-24.
[34] Cryopreservation and Freeze-Drying Protocols, ed. by Day and McLellan, Humana Press.
[35] Leslie et al. (1995) *Appl. Environ. Microbiol.* 61, 3592-3597.
[36] Mitropoulou et al. (2013) *J Nutr Metab.* (2013) 716861.
[37] Kailasapathy et al. (2002) *Curr Issues Intest Microbiol.* 3(2):39-48.
[38] *Handbook of Pharmaceutical Excipients,* 2nd Edition, (1994), Edited by A Wade and P J Weller
[39] Remington's Pharmaceutical Sciences, Mack Publishing Co. (A. R. Gennaro edit. 1985)
[40] *Handbook of Microbiological Media, Fourth Edition* (2010) Ronald Atlas, CRC Press.
[41] *Maintaining Cultures for Biotechnology and Industry* (1996) Jennie C. Hunter-Cevera, Academic Press
[42] Strobel (2009) *Methods Mol Biol.* 581:247-61.
[43] Gennaro (2000) *Remington: The Science and Practice of Pharmacy.* 20th edition, ISBN: 0683306472.
[44] *Molecular Biology Techniques: An Intensive Laboratory Course,* (Ream et al., eds., 1998, Academic Press).
[45] *Methods In Enzymology* (S. Colowick and N. Kaplan, eds., Academic Press, Inc.)
[46] *Handbook of Experimental Immunology,* Vols. I-IV (D. M. Weir and C. C. Blackwell, eds, 1986, Blackwell Scientific Publications)
[47] Sambrook et al. (2001) *Molecular Cloning: A Laboratory Manual,* 3rd edition (Cold Spring Harbor Laboratory Press).
[48] *Handbook of Surface and Colloidal Chemistry* (Birdi, K. S. ed., CRC Press, 1997)
[49] Ausubel et al. (eds) (2002) *Short protocols in molecular biology,* 5th edition (*Current Protocols*).
[50] PCR (*Introduction to Biotechniques Series*), 2nd ed. (Newton & Graham eds., 1997, Springer Verlag)
[51] *Current Protocols in Molecular Biology* (F. M. Ausubel et al., eds., 1987) Supplement 30
[52] Smith & Waterman (1981) *Adv. Appl. Math.* 2: 482-489.
[53] Brand et al. (2007) *Nature Protocols.* 2(5):1269-1275
[54] Jiao et al. (2014) *Immunopathology and Infectious Diseases.* 184(4):1085-93.

SEQUENCE LISTING (4 sequences)

SEQ ID NO: 1 - DNA, 1487 bp, Roseburia hominis
taaaggttgatcctggctcaggatgaacgctggaggcgtgcttaacacatgcaagtcgaacgaagcactttaattgatttcttcggaatgaagtttttgtgactgagtggcggacgggtgagtaacgcgtgggtaacctcgctcatacagggggataacagttggaaacgactgctaataccgcataagcgcacaggattgcatgatccagtgtgaaaaactccggtggtatgagatggacccgcgtctgattagccagttggcggggtaacggcccaccaaagcgacgatcagtagccgacctgagagggtgaccggccacattgggactgagacacggcccaaactcctacgggaggcagcagtgggtaatattgcacaatgggggaaaccctgatgcagcgacgccgagtgagcgaagaagtatttcggtatgtaaagctctatcagcaggaagaagaatgacggtacctgactaaaaagcaccggctaaatacgtgccagcagccgcggtaatacgtatggtgcaagcgttatccggatttactgggtgtaaagggagcgcaggcggtacggcaagtctgatgtgaaatcccggggctcaaccccggtactgcattggaaactgtcggactagggtgtctgaggggtaagtggaattcctagtgtagcggtgaaatgcgtagatattaggaggaacaccagtggcgaaggcggcttactggacgattactgacgctgaggctcgaaagcgtggggagcaaacaggattagataccctggtagtccacgccgtaaacgatgaatactaggtgtcggggagcattgctcttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcccactgacaaagtatgtaatgtactttctcttcggagcagtggtgacaggtggtgcatggttgtcgtcagctcgtgtcgtgagatgttgggttaagtcccgcaacgagcgcaacccctattcttagtagccagcggtttggccgggcactctagggagactgccagggataacctggaggaaggtggggatgacgtcaaatcatcatgccccttatgacttgggctacacacgtgctacaatggcgtaaacaaagggaagcaatcccgcgagggggagcaaatctcaaaaataacgtctcagttcggactgtagtctgcaactcgactacacgaagctggaatcgctagtaatcgcgaatcagaatgtcgcggtgaatacgttcccgggtcttgtacacaccgcccgtcacaccatgggagttggtaatgcccgaagtcagtgacccaaccgcaaggagggagctgccgaagcaggactgataactggggtgaagtcgtaacaagt

SEQ ID NO: 2 - DNA, 1485 bp, Roseburia hominis
gatcctggctcaggatgaacgctggcggcgtgcttaacacatgcaagtcgaacgaagcactttaattgatttcttcggaatgaagtttttgtgactgagtggcggacgggtgagtaacgcgtgggtaacctgcctcatacagggggataacagttggaaacgactgctaataccgcataagcgcacaggattgcatgatccagtgtgaaaaactccggtggtatgagatggacccgcgtctgattagccagttggcggggtaacggcccaccaaagcgacgatcagtagccgacctgagagggtgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagaagaatgcggtacctgactaagaagcaccggctaaatacgtgccagcagccgcggtaatacgtatggtgcaagcgttatccggatttactgggtgtaaagggagcgcaggcggtacggcaagtctgatgtgaaatcccggggctcaaccccggtactgcattggaaactgtcggactagagtgtcggaggggtaagtggaattcctagtgtagcggtgaaatgcgtagatattaggaggaacaccagtggcgaaggcggcttactggacgattactgacgctgaggctcgaaagcgtggggagcaaacaggattagataccctggtagtccacgccgtaaacgatgaatactaggtgtcggggagcattgctcttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcccactgacagagtatgtaatgtactttctcttcggagcagtggtgacaggtggtgcatggttgtcgtcagctcgtgtcgtgagatgttgggttaagtcccgcaacgagcgcaacccctattcttagtagccagcggttcggccgggcactctagggagactgccagggataacctggaggaaggtggggatgacgtcaaatcatcatgccccttatgacttgggctacacacgtgctacaatggcgtaaacaaagggaagcaatcccgcgagggggagcaaatctcaaaaataacgtctcagttcggactgtagtctgcaactcgactacacgaagctggaatcgctagtaatcgcgaatcagaatgtcgcggtgaatacgttcccgggtcttgtacacaccgcccgtcacaccatgggagttggtaatgcccgaagtcagtgacccaaccgcaaggagggagctgccgaaggcaggactgataactggggtgaagtcgtaacaagggtacg

SEQ ID NO: 3 - DNA, 1500 bp, Roseburia hominis
  modified_base (862)..(862): a, c, t, g, unknown or other
  modified_base (933)..(933): a, c, t, g, unknown or other
aagagtttggghcaggctcaggatgaacgctggcggcgtgcttaacacatgcaagtcgaacgaagcactttaattgatttcttcggaatgaagtttttgtgactgagtggcggacgggtgagtaacgcgtgggtaacctgcctcatacagggggataacagttggaaacgactgctaataccgcataagcgcacaggattgcatgatccagtgtgaaaaactccggtggtatgagatggacccgcgtctgattagccagttggcggggtaacggcccaccaaagcgacgatcagtagccgacctgagagggtgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagaagaatgacggtacctgactaagaagcaccggctaaatacgtgccagcagccgcggtaatacgtatggtgcaagcgttatccggatttactgggtgtaaagggagcgcaggcggtacggcaagtctgatgtgaaatcccggggctcaaccccggtactgcattggaaactgtcggactagagtgtcggaggggtaagtggaattcctagtgtagcggtgaaatgcgtagatattaggaggaacaccagtggcgaaggcggcttactggacgattactgacgctgaggctcgaaagcgtggggagcaaacaggattagataccctggtagtccacgccgtaaacgatgaatactaggtgtcggggagcattgctcttcggtgccgcagcaaacgcaataagtatnccacctggggagtacgttcgcaagaatgaaactcaaaggaattgacggggacccgcacaagcggtggagcntgtggtttaattcgaagcaacgcgaagaaccttaccaagtcttgacatcccactgacagagtatgtaatgtactttctcttcggagcagtggtgacaggtggtgcatggttgtcgtcagctcgtgtcgtgagatgttgggttaagtcccgcaacgagcgcaacccctattcttagtagccagcggtttggccgggcactctagggagactgccagggataacctggaggaaggtggggatgacgtcaaatcatcatgccccttatgacttgggctacacacgtgctacaatggcgtaaacaaagggaagcaatcccgcgagggggagcaaatctcaaaaataacgtctcagttcggactgtagtctgcaactcgactacacgaagctggaatcgctagtaatcgcgaatcagaatgtcgcggtgaatacgttcccgggtcttgtacacaccgcccgtcacaccatgggagttggtaatgcccgaagtcagtgacccaaccgcaaggagggagctgccgaaggcaggactgataactggggtgaagtctacrsagggtagccgtrmmc

SEQ ID NO: 4 - DNA, 3592167 bp, Roseburia hominis (residues 1-1,796,084 of 3,592,167)
gtgcttgaatatggtgcttgtcattgtattcaagctcggcgttgccggtgtggcgatcgccacggtcatctcgcagatgatttcctgcgtgctggtgctgcggtgcctctgtcggtcggagagcagttaccggctgcggttttccgagcttggcatgaaagggtactacttgaagcagatcttttcggtcggcgttccggcaggaatccagagtacggtcattaacttttccaatgtgctcctgcagtcctcggtcaattcgttcggatcgacggcgatggcaggctacacggcggcaaacaatctgctcggcttcttgtatgtctcggtgaactccatcacacaggcgtgcatgagctttaccagccagaattacggcgttggaaaattaaagcgcatggatcgtgtgctggcagactgcatgatcttatcggtcgtggtcgctgtggttttgggatgcatctgctatgggttcggaccggaaattttacagatctacacggaggatgccgaggtaattgcgtgcggtatggagatccttgcatacacgacgatcacctattttctttgcggctggatggatttgttcccgggggcgctgcgcggcatgggatattccgcggtgccgatggtgttgtcggtcatcggaacggttggtacgagagtggtgtggatttttggcatttttccataccacagatcactggcgattctgtttatatcttatccagcgtcgtggattatcacgattgtcctgcaggtaatctgtttttactttgtgagacggagagtgcaccggagaagtcaggcgctcgccggacaggaagcctgattcctcaatcagccaggaaacccagtggaaagtgacaggtcatctgtcggaactctgccggatcgaggcaaaagcccaatcccagaatccgacaggaaccccagctcatagtccagctcatataactacacggagacaacgatggaagcatattattacagcaaaatggacaaaacaaagcaggcggcatatcatgcgatgctgcagggactattggcgttggaggatgccattccgatgccgcgccttgaggcggaggatctctatcaggtatttttcctgctgcggctggatcatccggagattttctgggcgaccggctacaagtaccggtattatccggagtcggcgaaccttgtgttcctgccggaatacctctttgaaaaaggcaagatcagagagcaccagaaggcgatgaaggcgcgggtggaaaaactggcgcgcgcggcgcagaatctctccgagtgggagaaagaaaaatacgtccatgactttatctgcgaaaacgtgcactacgataagctgaaaaagccgtattcccatgagatcataggtcctctcggacagggtgtgggcgtctgtgagggaatcgcaaagtcagtaaaggtgctttgcgatgcgcttggcgtttggtgcgtgattgctctgtgcggaaactgcccagagaaggggatcaaataccgccatacgtggaacattgtaaaaatcggcgggcagtattatcatctggatgccacatttgacaacacgctcggtgcgggagcacagatccggtacgattatttcaatctctgcgacaagagcgtattccgggatcatcagcccctgatcgcgcctgcgccggaatgtacggatgcacagcatttttattatcgggagaaaaagctttccttcacgaagatggaggatgtctataaacgtgcgcttcagacagcaaaaaaaggaaaaacgtttacctttcactggaggggcgggtatctcaccagggaggtcttgggggaactgttagaacagatttccgcggccggcagggagcgagaaaaaagcgccagagtcagtgtgaactggcagcaggcggtgctccggttcgattatgtggaggcgggcagcgcgccggaggcgagtgttgtgatggaagaagcaaatgagggagaaaaagaatgacggaagacttactggaacagattcagagaaaagacgcggcggcgtttacacacggagggaaatttcatgcagacgatgtgttttccgcggcgctgctgctttacctgaatccggagattgtaattacgcgcggcaacagggtgccggagaattttgccgggatcgtgtttgacatcggaagaggacggtacgaccatcatcagaaagacagccgggtgcgggagaacggtgtgccctatgcggcgttcggactgctgtgggaggaactcgggggagcaatcctcggggaggagctggcggcggaatttgacgaggcgtttgtacagccgttggataataacgacaacaccggggagaaaaacgagctggcgacgctcattggcaattttaacccggcatgggatgcgcagggcggaagcgatgccgccttttttcaggcggtcagcgtggcaggcatgattcttgaaaataaatttgagcgctatcgcggaaatgagcgcgccgaccgtcagatcgaggaagtgctggcggcgcatgagcgtgccgtagtgtccggggagacggcggagcgcgatgccgcgattctcatattgccctattttatcccgtgccagaaacgcctgtcggagaccgggattgcgtttgtgattttcccgtcgaaccggggcggatactgtatccagccgcagaagcgggagtattctctccattataagtgcagcttcccggaatgctggctcggactggaaaaggaagaactggcggaggcatcaggtttagagagcgccgttttctgccataagggcggttttctcatgacggtcggggaactttccgatgcagtggaggcatgccggatcagtctggacagctttaaggaggagaaggcgcttgtaaacgtgggcggcggagagacagcggatgaacttttaagagaactgccggggatggcggaagcgcagatctatcacatgccgctgccagagctgccggaactggaacaggacggcagttacggtgaagtggcgatggaaaaagccgactggaagcttcggaacaaggattatgtgaaacagatcctgcagtgccgtccggaggccgtttacgtcgagggggatgtatttgcggcatatccggtggtgcatctgctccggaaaaagcacgtgccggtgcttgccatggcggagcgcggcgggaagcggattctcgtgcggattccgtccggttcctagatgggacttgtagaagacaagcgaaaagtgctatgattcttatgcaatgtggaatatgctttcaggaatttctgcttccggcgaagaggcaggaaaatcagatagacataccaaggaggaatggacaatggcttgtacaacgattttagtgggaaaaaaagcatcatatgatggatcaacgatgattgcgcgcaacgacgattcgggttcgggacattttacaccgaagaaatttgtggtcgtgcagccccaggagcagccgcgacactacgagtctgtgatttcacatgtgaagatcgagctgccggagcagccgatgcgctacacggcggtgccgaatgcggtcgacgggaaaggtatctgggcggcaagcggcgtgaatgaggcgcatgttgccatgacggcgacggagacgatcacctcgaatccgcgcgtgctcggcgtagatccgctggtggtataccagaaggcagaggatggtcagccggagatatgtggagggatcggcgaggaagatcttgtgtgtcttgtacttccgtatatccgcagcgccagagagggtgtcagacgtctgggaagcctgctggagcagtacggcacctatgagatgaacggcattgcatttcaggatcaggatgagatctggtggctggagacaatcggcggacatcactggatggcgcgcagagtgccggatgatgtctatgtggtcatgccgaaccagcttggaatcgaccggtttgatttttccgatgccctcggggagcagaaggaatatatgtgctcggcggatctggaagaattcgtaaagacgtatcatctggatctctcacaggatggcgagtttcatccgcgcgacgcgttcggcagccatgacgatgcggatcatgtatacaacacgccgcgtgcgtggttcatggagcgctatctgaatccgcacacgaaggtgtgggacggaccgcatgcggatttcacaccggtttcggatgatcttccgtggtgcatggtgccggagaaaaaggtgacggtggaggacgtcaaatacgtcttgtcctcccatttccagggaacgccgtatgatccgtatgccgcttacggggataagtccctgcgcggtgcataccgctcgatcggcatcaaccggaacgattttctcgcagtgatccagatgcgcccgcagatggagcaggagaacggcgtgattgaatggctggcatttgcgtcgaacgcatttaacgtgttggtgccgttctatgccgatgtggaggagacaccggaatatctggcgaacacgacgggcgaggtgtccacggagaacttttactggtcgagccggctgattgcggcgatggcagacgcatcctaccggagctcggtgttccatatcgagcgctatcaggagcatgtgatggcgaagggacacgagctgatccatcactacgacgcgctcctctccaaggagacggatgccgtgatgcgcagaagacttcgcgaggaggcaaaccgcagtattgcgaagatgctgcagaaggagacggcagataccctggacaaggttttatatgaacttagcggccagatgaagaatgcatattccagatcggatgcatagggaggactgccatggtaaaaattgatctgatcacgggtttcctcggatctgggaagacgacgtttttgaaaaaatatgcgaaacgcctgatggagcaggggcagaatatcggaatcctggaaaatgatttcggcgcggtcaatgtcgatatgatgctgctgcaggagttagagggggagcagtgcgagctggagatgatctccggtggctgcgaccccgagacgcaccgcagaaggttccgcaccaagctgatcgccatgggaatgtgcgggtatgaccgcgtgctcgtggagccgtcgggaatctacgacatggacgagttctttgacgtgctgcacgaggagccgctggatcggtggtatgagatcggcaatgtgatcgctgtggtggacgcgcggctggaggacgcgctttcgccggaggcggagtacctgctggcatcgcaggcggcaaatgccggctgtatgattttaagcaagtgcgacacggcgacagaggagcagcggcggaatacaatcgcgcatctgaagcggtcgcttacagcactcggctgcaagcagcgggcggatcagaaggttttgtgcgagggcgcagaaccgctcccggatcaggattttgccacaattctctcctgcggttatcacatcgcaagctatgagaagccggactttgcgaagggacagtcgtttgaatcgctgtattttctggatatgcacctggacggggatgcggttacggcggcggtgaagaagatgctgaaagatccgtcgtgcggacatattttccgtgtgaagggatttttgcagaattcggacggcacatggctggagatcaatgcaacacagcaggagatcacgcgaaagccgattgcaaacgggcaggacgttctgattgtgatcggagagaagcttgtggaagacgccatccgggcgtattggaaaggttagagacagacgatgatttatgtggtgacggcgctctatcaggaggcacacggattcatccgggaactggaattaaaaaagaacacggcgtatgcgccatttgaggtgtttgacaatgagaacgccggcatccggctggttgtgaccggtgtgggggagattgcggcggccgcggtggtcgccgcagtctgtgcgcaggatggagctgatgcggcagactttctcatcaatatcggctgctgcgcggcagcaaacgctggcgcggacagtggctgtgaaactgtagacagtggcatggacagcggatacggggcggcacacgccgcacagatcggagacctgtacgtgtgtcacaagatcacggagcaggcgaccgggaaaacgttctatccggatattctgtaccggcacccgtggaaggaacgtgaacttgtgaccgggatgcagccgctgcaaagagcagcggcacacggagctttatatgatatggaagcggcggccgtctatcaggcaggcatccgctttttttctccggaccggatgctttttttgaaggtggtatcggatttcggaattgcagggcaggagagaatgacggcggaggcgctcacggggctgctggagcagcatgtaaaggaggtcgtggcatttcttacaaatctgcgggaggcggcagacgaggaggagacgctgcgaaacgacggtattttgcaggaagacgagacggtgctggagcggctttttgcggcgctgcactgctcgcagacgatgcgggcgtcggcgcggcagtatatcacgtatgcggcgcttaccggatacgactggaaagcggaactggaagaatggtatgcgcgggggctgctcccgtgcaaagacaggcgggaagggaaggtgcggcttgaagaacttaaacaggtcttattataatccgccgttttcccatatttatgtggagcgggaagtggcggaagatccggagactaagcggatgcttgcgcagtttccgcaggcggaagtgattgacatcgaccactataaggatgttttctgccggagcaggcaggactatgtcaggcagcatgcggcgcagaatctgattctggcggcgaagcacggtgagctgctctaccccggcgcgccggtctgccagaactttggaaatgagcatttttactacacctcctgtgtgatgaactgcgtgtttgactgtgaatactgctatctgaagggaatgtatccgtccgccaacctggtggtgttcgtcaatcttgaggatatttttgcggaagtggaaaagagacttgacgcgcacccggtctacctgtgcgtgtcctacgacacggatctgctggcgttagagcatctgaccggttatgcggcacgctggattgagtttgtgcgcaggatgaacaccggcgggcagcggctgcgcatcgagcttagaaccaagggaaccggaggcagcctgtggcagacggtccggccggaggcaggtgtcatctgtgcgtttaccatctcaccgcagcaggtgattgatgcatatgagcacggtacggcttcgctcgccgggcggctggcaggagcggaagcggcgatggaacaaggcttttcggtgcgtctctgctttgacccgatgatctattgcagcgactggaagaagcactatgacgcgatgtttgcgcaggtctgcgggacgctggacctggaaaaactggcggatgtcagcgtcggaaccttccgcatctcccaggattatctgaagaagatgcggaaaaatgagccggactcggcggtggtgcagttcccctaccagaatgacggcggggtgtaccattacccgacggcgctcatggaggagatggagcagtatatgacggaaaaacttgccgcttatcttccggcagagcggattttccagtggaaggaataaggagagaatacatggagcagtgtagagaaaacgaggcggcgattgtcacgggggcgtcctccgggatcggggcggcgatcagtgccagactgtgcaaaatgggatatgaagtgtttggcatcggacgctcgttcggcagcagtttcgcggaacagtttccggacgttgcagataatccgctgtttcatgcggtggtctgcgatcttctggacacggaaaaaatgttgaagctggtgcgggggattgtggcggaagccggggtaacgctgctcgtcaacaatgccggcagcgcgtactacggactgcacgaggaactaagcccgaagaagattcaggagatggtgcgcacagatctggaagtgccgatgattttaagccagcagctgctgcgcgggtttaagaaaaacaagggctgcatcgtcaatatcgcatccgtgacggcgcagcagtcgaatccgcacggctgtgcctacggcgcggtaaaggcaggacttgcgagcttttcgtgcagcctctttgacgaggcgcgaaaatacggtgtgcgcgtggcgacggtatccccggatatgacgaagacggaattgtatcgcaatgcagactttacggtgggggaggagacggagagctatcttctgccgcaggacgtcgcggaggcggtggcgtatatcgtggggcagagagagggcgtggcggtgtcggaggtgacgctccgcccgcagtatcacagaatccggcgcaagccggtagcgaaaaaggagagaccggtcgaatgaaagatcttacaaaaggaaaaccgtcaacgctgattcttgcgtttgcactgccgatatttctggggaatctgctgcagctgacctacagtgtgaccgacacgagaattgtcggctcttttctcggggaggatgcgctcgctgcagtcggtgcaacgacgacactcagcaatctcatcatcggctttttgctcggactggcgaacgggtttgccatcatcacggcgcagcggttcggcgcgaaggatatccggggcgtgaaaaaatcgtttgccgcttccctggtgctcggaacggtgatctcggtcgtgctgacggtgctaggactggtgtttttacagccgatcctgcggtttttaaatgtgccggagcatctgattccggtggcaggaccttacatatttatcatcatagcgggacttcttgcgacattcctctatgacgcgtgtgccgcagcacttcgggcgctcggggataccgtcacgccgctcgtgattctggcagtgtcggtggcgttaaatatcgcgggagatcttctgttcgtgctggtgttaaaggcgggtgtgcgcggagctgccgccgccacggttctggcacagattctggcgtttgtgatctgctggatctacatgctaagacggtatgaaatgctccgtcttgcacaggaggatttccgggatgcggatacggcgatggtgaaaaacatgctcggatcggggctgtcgatgggctttatgagctcgctggtcaatatcggctcgctgacactccagacggcgatcaataagctggggcaggacatcatcgtggcgcacacggcggcgcggaaaatttccgagatttttatgacgatgttcagcgtcttcggacagacgatggcgacctactgcggacagaatctgggcgcgggcaggatcgaccgggtcaaaaaaggcatccggctcggcattttctacacctgcatctggtgtacgctttccgcggtggcgagctacacgattggcagatggctggtatatcttgtgacgggaagcacgaatgaggttgtgatcttaaatgcgaccaactacctgaaattcgacacgctgttctactatgtgacggcggtgatctgcgtgctccgaaacgccatgcagggactgggcgatcatatcacgccgctcatttcgagttcgcttgagatggtcgggaaaatcgtgatcgccgccacgcttgtgccgatgttaggctacaccggtgtcattgtggcggagccgctcgtgtggtttatcatggtaattccgctcgtcgtgcagatcttccggatgccggtactttgggaagaaaacatgggaaatcaaggaaaatgatgcgtagttggacgataacaacgcttgaaatgctgtaaaatcaagcaattacaggatttcacaaaaagttcacagaaaattagcactcaacacttgacagtgctaataaacggtgttataacatagtcagaacaaaggagaggaacaaaaggagaacaggaaatgagttctatgagttcccagaacatcccggttccaaagaaacaaggaaacagcatgagtgtatctgccgaaggcaggtacgaagtagaaaaggagagatgacttatgttaacacctagtatttttggagagaacttatttgatgactggtttgatgattttccatttttcgatgacagagatttgcgcaaggttgacaagaagctgtacggcagaagagccggtaacctgatgaagacagatattcaggagatgaaggatggctacaagatggaagttgatcttccgggcttcaagaaggatgagattaccgtagagctggatgacggatatctgaccatcagtgccgccaagggactggatcaggacgagaaggagaaagaatccggacgttacatccgcagagagcgttatgcaggtgcctgcagccggagcttctatgtgggcgagggcgtaaccgaggaggatatcaaggctgagttcaagcacggtatcttaacgctggttgttccgaagaaggaagcaaagcctgcagtagagcagaagaaatacattgcgattgaaggataaggatgacagagagaaaggaagcgtatgatcatgtcagataagaatccaaaacatccgttgaagaagaaaaaagtagcagcaaaggtgaatatggcagaccatgaggcggtcgaggaagcgagagaagcccacaagtcgaaaaagcatgtttactaagcgatacgcctgcagatgacaggagaaaagggacagggagctgcacagcacgaagtgctgtgcgcccctgtccctttttcgtcattaggctttagcctgctgaatgcgtgtttacgagtttctcaacagagaaacgaagtacgcataaagcaaaaacccacctgctatgcgggtggagtcaaatcgttatacagaaaaacacctttccgttacaatagagttgttcagtcactattgcaagaaaggaaaggtgttttatggcgaataagtctaatgatctcgcccatacaaaatggatgtgtaaataccatattgtatttactcctaagtatagacgaaaaattatttataatcaattaaaagaggatatacgtgatattctgaaacagttatgtgcatataagggcgtggagattattgaagggcatctcatgcctgaccatattcatatgctagtaagtattccgccaaagatgagcgtgtcgagttttatgggatatttaaagggaaagtcagcgcttatgatttttgacagacatgcaaatctcaaatataaatttggaaacagacatttctggtcagagggatattatgtcagcaccgtaggattaaatgaagcgacaataaaaaagtatattcaagatcaagaaaagtacgatatcatgcaagataaattaagtgtgaaggagtacgaagacccttttaagggttaagtcgaagtagtacaaacgcccattcatgggcataagcaacgcgtcaagtgcaatagtgacttgaacgaagagaaagtctagggcgccttgagacgctgtcgggtaccaaggggttacacccagcgtcccgagccaccctttttaagggtggcggcgactgtaataggaaacttcgttcctattacacaaaaacgtgtccaaagattacctattcgctaatccaactgcatggagttgagtttttctgccagcagatccagaaagcgcttgccgaaattacttagttcgtgatccctgcgggagatccagccaagttcgatccgttgatgcgtgtccagattcatgacggcgtaatctttttccagcagattttcaccggacatgccggaaccgatggtataggtgttcatctccatgccgatgctggcatctgccatctcgtccgtgagggtgattgttttttttgcgacggtattctccacaagctcctcggagaagaagcggtctctggaactgtcgattccctgaaaatagtggctgtagacatagggagccaggtcttccatcgataccttcgtcctgccggcgagcggatgctgcttgggaacatagactttggggcgcatggttgccagcagatgaaaatcaagttcctgctgctccatctcccagtcgagaacgcggttctcacggtttttcaacagaacgccgatctcacagaattccgatgcgacgtaatctaagatctccttggtgcgcagctggagatactggaaattgtattcgttaaagtgcgggtcctgctccttcatgaaggcaatcatgacctctgtcacaatggaaatgtgctgtgtggcaacgctaaaagagatcctgtggctgctcggctgtttgtaggtgtcctcaaggcgctgcacctggtttaagatcggctggatcgagcgaaccagctcggcgccgtcgggggttaaagagacgccactttttttccgctcgaagatctggatgccgagttcctgctccagatctttgatcgcgttcgacagattgggctgtgacagctggaatttctcagcagcacttgtgatggaataacattctgcggttgtaatcacatatctcatttgttgtagtgtcatggttatactccttttgtcagagctgcctgctcacgtttcatctgcgcattgtgccgcacaaacatgccggcggcgacaaggtttaatagaaactgtgtaatcacggcagtcagccagattccgtccgtcccgaagaaatgcggcagcactgccaatgctgcaggagtcagacagagtggatcaaaatagatcataaataaagaatagcggttctttcctacggcatagaagaagctgttggttactctcacgatgccggtaaagatgagctgggcagcggtaagcataaccgcgtgatagccggcagcagcagcgtctccctgatagccgtacagagccggatagaaggaggcggtggcgatggtgaacaaaaacagaagaacgctggcggcaatcgcagtccggatggctttgttacggatatgccggatctcgtcgtaggcggcgatccgctctgcgggagtggcatttccgttctgcgatgcgccgtaggctttgctggcaagcggctgcattccctccgcaacgccgatcagcagaatccggtacgagccgatggttgaggagatcagcgcatatgcgctcacggcaagatccccgtaattcaggcaggcgatgttgtgatagagaattaaaagcgacggcgtcagtgatattccgaaaggagagattccgatggaaaaaatgcgcttccagcagtctttctcaaagacgaactgctccctgtgcagggggcagagagatgtgccggcagagcccggaaggccgagccgcgcgcggaggcggtctgtgacaccgaaaagtgtgagaaaacagagggcggtggtcagcagctgcgcgcccaaagaggccagagcggcgcctccgattcccagatggaaaaagtaaagcagtacgaaatccatcgtgagattaaagaggaaccccaggaccatgatggtcatggcaccgacctgccggttctcattccttaatataggtgcaagtccgcaggataaaacctggatgacgccgcctgcaatcatgattctgccgtactgttccgcagcggtgagcagattgccggaggcgcccatcagttttagcagcggcgttaaaaatagagggacagtatgaagcgggatatgcctcgggactgacaaaagcacagacctttttccatgtgattgtgccgcaggcggtgcgggcggtcattccgccgctcacgaacgatattctctccctggtaaagggaacggcgttagtgtcggtcatcggagtgtcggatattctgacggattccatcaatgcggcaagcgcggcgtactcttacctggaggcgtatgtggcggcagccctggtattctggggcatcggaattgtgttagagcggctaagccactatgtggagcggaaattttcaaaaagcgttaagacactggcaggctgagatgcggtacggcatcgtacattattataataggaaggaaacagggctatggcagtattagaagtgagaaatgtaaaaaaggtttttggagataacgtgattttaagaggaatcgatcttgatgtacagaaagggaacgtcatcgtcatactcggaccgagcggttccggtaagaccacctttttgcgctgcctgaatcttctggaaaaaccggatgaaggctcgatggtcttaaacggaagagaatataacttaaaaaatgtaaaaaataaagaaaagctggagattcggagaaatacttccttcgtttttcagaattacaatctcttcgtgaacaagacggttctttctaatgtgacgctggggcttaccgtgggacgccatatgaaaaaggaagaggcggagaagatcggaaaagaactgttagacaaggttggtcttgcaggaaagtacgattattacccggcacagctatccggcggcatgcagcagcgtgtcggaattgcacgggcaatggcggcgaatccggaggtcattcttttcgacgagccgacgtccgcactcgatccggagctggtgggtgaggtgttaaatgtcatgaaacagttcgcaaaacagggagtcacaatgattgtggtaacacatgagatgcagtttgcaagagaagtggcaagccaggttattttcatggcagacggtgtggttgtggaaaaaggaacgccggaggagatctttgaccatccgaaggaggaggcaaccagaaaattcttaaaacgtattttaaaggaagagtcatagctgtgtgcgaagacggagaggagagaaagatatgcagaaatatgtgatttcgatttcaagacaattcggaagtctgggaagaccgattgcaaagaaactggcagaacttctggaaattgaatactatgacagggatattgtggaggaggcatccaaagttcacaacattccgttaaaggaagcgagcaatctggaggagtcggcaaagtatctgttcatgagtttcccactcggcagcggaaccacggcgacgcaggatgccctgtttaagacggagagcgagatgataaaaaaacttgccgtgaaggaatcctgcatcattgtcggcagatgcgcggacgcaattctggaggattgcgatcatctgatcagaatttttatctatgcgccgtacgaagaccgcattgtcaactgtgtcaatgatctcggcatggacacaaaggcggcgaagcggatgatccgtgatgtggacaaggcgagagatgcctaccatatgcggtatgcggggtatctgccgaacgatatgaaccatatggatctgatggtcaacagcgcaactctgggagtcgatatgacagcgagactgttggcggaagtggtgcgtgataaattttcataagacgggcagtgtgcgtaagactgcacagtgccacagaggataaggcatggaaaaacacagaaaaaaactgatcaaaaacgcagcggtattcgacgggcacagcagtgggctggcgcatgggaaaaagattgtcattgaagacgatcttgtcacagagattaccggggatgaagtatcggaagaaaattttgacgaggtatttgacggcacgggcatggtggcgatgccgggaatgacggacgcgcatgttcacatgggctgtctgttcgcaaagggagaattcccggtggattacgctacggtgctgaccgtcgcaaaatgtaaggatgcgctgatggccgggtttaccacgttccgtgatgcgggaagtgtgagcgagggattaaagctggcgtttgacgagggtgtgcttccaggtccgcgcatctatccctgcggtgcctacatcagccagacgtgcgggcatggggattcggagtatgcgcatacctatcgcgacatccagtacaggcatccgtccagcaccgttttggcggacggggtgccggagatcatccgggcagtgcgcgagcagttctaccgcggtgcatcccacatcaaactgatggcgggcggcggctgcatgtccagctgtgacccgattgagaccgtacagtttacagcggaggagatgaaagccgcctgcgatgtggcagcagattacggaacctacgtcatggcgcatctgtatacgccgaaggcgatcctgcgcgcgctgggagcgggcgtgcggagtctcgagcacgcacatctcatcgacgagacggcggcagagcaggtggcggcggcaggagcatttttaaatcccatgcctcagtttaaaaagtatgaggacatgctcggtgtagagaacatgccgccgaaagacgagatggtgtgctgtgcggaggcgacggctaccgagatcttaaaccggcatgaggatatcaggcttttgttcggaacggatatgatgatcacgggaccggattatcaggtggagcagagcgaggatatccggtattacgaaaagcgcttcggcacaatgcgggcgctgagggctttgacgggcactgcaaacgaggtgtttgcacttacgacctaccagaatccttacccgaagggaaagatcggtgtgctggaggcgggatcctatgcagatctgcttctggtggatggagatccgacaaaaagtgtatcggttcttgcagacaccgatcatctgcgcctgattatgaaagggggaacggtgtacaaaaatacactgtgctgagattttattccgctaatacgctgacttgcatgtggctgagattcgtagtaatcttattccaaaaactagaagcaggaggtaattatgaaagagctgctgtactggattgtggaatggattgcgaagattcacagccacattcttcgtctgaatgatgcgtatgaatacaattttacagataaagaactgcattttctcgtcattggtatgatgggaatgggattcatttttgtcgtgtatcctgtttttaaatggctggcaaagcatgatcatgtcatggtaattgcgtggatttatgtgctgacactgattatcgtgatcacgtttgccatagagatcgggcagaaagtaacaggcaccggcaatatggaatttgcagacattgtgatgggtgtattcggattcattgtaatgttccttgtgttctcggttgtgcggggtatttataagctgataagaaatctgatcagaggagacaggaaagatgaatgaattttggaaaagagtgctcgagacgtgcgtggtgattctggggaactgcctgtatgcattcggtgtggcaatgttcattgtgccgggaggactgattaccggcggaacgacgggaattgcgctgtttgtgcaccacatgatgggttgttccgtctccgtgtttgtactgctgttcaatacggttatgtttctgatcggatttgcggtattcgggaaaaaatttgcagcaaacacactggtcagcaccttcagctatccggtagcgctggagctgtttacacggcttctgcacggctatgcgatcacggacgatatgattctctgcatgatctttggaggaatctgtatcggaggagccatcggcgttgtgatccgtgcgggcgcatcgactggcggcatggatataccgccgcttgtgttgaaccgttattttaagataccggtgtcaaagtccatttatgtattcgatatgctgattttgctgctccaggcgtttgacagtacaggagaacagcttctctatggtattctgctggtgattgtctacagcgtggtgctggataagtgcctgatgcttggaactgcaaagatgcagatcaaagtagtcagtgagaaaatcgatgagatcagaaaagcagtcttaacagatatcgaccgcggtgttacaatgttaaaaagtgagaccggatacatggagcgggagacagagatgctgcttacggtggtgtcaatacaggaactggcgaagacggagaagctgatccattcggtggatgaggatgcatttgttgtgatcaatcgtgtcagtgaggtttccggccgcggtttttcaagtaaaaagcgttatctggaaaaggagaattcatgacattacagcaactgagatatgcactgacgatagccggctgcggatcgatgaatgaggcggcaaagcgtctgtttttatcgcagcccagtctgtccgagacggtaaaggaactggagcaggagatcgggctgcagatttttatgcgctcgaaccggggaatcatcatcacaccggagggtgaggagtttctggggtacgccagacaggtgatcgaccagtacggaatccttaaggcgcgctatgtggagaagcagcgcaaggaaaagttcagtgtgtccatgcagcactatacgtttgcagtcaaagcgtttgtggagactgtaaagaaagcagggatggacagctatgaattcgcggcgaacgagacgaccacatacgacgttatggagaatgtacgcaattttaagagcgagatcggcgttctgtatctgaacgattttaatgagcaggtgctgatgaagatcatccgggagaaggggttggagttcgaggaactgtttgcctgcgatacctatgtctatctgtggtcgggacatccgcttgcagggcagagcgtgatctccatggaagaactggacgagtatccgtgcctgtcctttgaccagggacggaacagctcgctctacctcgcggaagagatgaagagcacctacgattataagcggctgattaaggcgaacgaccgggcaacactgctaaactttatgattgggctgaacgcgtacacgctgtgctcgggaattatctgcgaggagctaaacggcagcgattacatggcaattccactcaaggagacggaaaagatgcggattggctatgtgaagcgcaaaggggcatcaatcagtcacatcggacagatctatatcgaagaattgaaaaaatataaagagaaaattatgtagtggttggctataggtttcacctatagccaactatcggcttcctgtattaacactttcccaaactgcctgttataataggcaatgtaatcaaaaaaaacatgcagataacagatggcatggagcaaaaagcaggaaggaggaaacgggtatgagagacacagcgtggcagatgagaacagcgatgatgtgtgacaggatgtgtcggatgtccatgtatggtggcatggatgtgaatgttgtgcggcttttcccggattcttcagacctttggaagaacagatagataccggcgctatggagcgcaggttggggcagccgcagggctgcttttttttatttcataggaaataccgtgatacattcatgtgtgaaagtggaactttcctatgaaataaaaaacgctccgcgaggatgcgcagctcgcggtaaggaaaatattgctttgcgaaccgctcgcgcgcggagaatctcgcaagcgagattctttttaattctatgtttttgaaataacattttaggaggtggcagtgcatgccagcaattgcgatacgtcatttatcaaagaccttcgagcagaagggaaacagtgtggaagcgttgcgggatatctcgctcgacattgaggagggagacatctacggaattatcggaatgtccggtgccgggaaaagtactctggtgcggtgcctgaattatctggagaggccgacgggcggtgaggtcatcatcggtggtagagatctgggaacgctgaccgagaaagaactgcgggagcagcggagcgacatcgcaatgattttccagcatttcaaccttctcatgcaaaagagtgtgctggacaatgtatgtttcccgatgcagattgcgaagaaaaagaaggatgaggcgaagaaaagagcgcttgagctgctcgagactgtcggacttgccgacaaggcggacgcttatccggcacagctttccggcggacagaagcagagagtggcgatcgccagagctcttgcgacggatccgaagattctgctctgcgacgaggcaaccagtgccttagatccgcagacaacgcagtccattctggcactcttaaaggagatcaaccggaaattcggcatcacgattgtgattatcacgcatcagatgtccgtgatccgggaaatctgcagccatgtggcgattgtggaaaaaggaagcatcgtggaagtcggcctggtcgaggagattttcaaccatccgaaatcccgtgtggcgagaagcctgatcttgagcgaccgtgctgcggatgccgcgtcatattccggggcggaaggtgatactgcggatggagcggagctgaccggatggagcggtgagagcagacagcgggaccgcatcggcgacgataagaagcttcgtattgtattctcagagaattccgcatttgagcccgtcattgccaatatggtgttaaagttcggtacgccggtgaacatcctccgcgcagataccaagaatgtcggcggagtggcaaagggtgagatgattctgggacttccgtcagacgccgggctgcaggagcagatggaggcttatctggtggaaaagggacttgagattgaggaggtgaccggagatgtggaatagtcaggtaatcatcatgcttttggagggaatccgggacaccctgtatatgaccttagcgtccacattgtttggatatatcatcggacttccgatgggaattgtgctgactgtcacggacaaggacggcatccgtccgaatgcggcagtctacaaggtgctggatgtgatttccaacctgctgcgcagtattccgtttattattttgctgattgtgctgattccgttcaccagatttgtggtgggaagaagctacggatcgacggcgacgatcgtcccgctgacgattgcggcggcaccttacattgccagaatggtagaatcctcattaaaagaggtggatgcaggcgtcatcgaggcagcgcgctccatgggagcatccgattttcagattgtgaccaaggtcatgctggtggaggcgagaacgtctctgattgtcggagcaacgatttcccttggcacgattttaggatattccgcgatggcaggaaccgtcggcggaggcggactgggagatattgccatccgctatggttacaccagatggcagaccgatatcatggttgtcacagtggtgcttctggtaattttattccagattttccagacgatcggaatgaagattgcgaatcggctggatcgcagaaagtagcaataacaaatttgcatatatttttaagttttaaggaggacactattatgaaaaagaaagtattgtcaacgattctggcaggcgtgctcgcattatccgcattcgcaggatgcggaagcagcacggaggagagcacagacaccagtgcagcaacaaaggaagagacgcccgtagctgcaacggaggaggctgtgagtgctgagaacacagagagcaccgataccgcagcagaaggcggcaccatcaaagtggctgcatccgcaacaccgcacgcagagattcttgaggaagcaaagaagattcttgccgatgagggatggaatctggagatcaagattttcgacgactatgtaatgccgaacgaagtggtagaaagcggcgagtttgacgcaaactacttccagcacattccgtaccttgagagctttaacgaagagaagggaacccatctggtcaatgcaggcggcatccactatgagccgttcggcatttatccgggaacaaagtccgatctctccgagctggctgacggcgacaccatcgcagtgccgaacgataccacaaacgaggcgagagcacttcttctgttacaggataacggcatcattaccttaaaggaaggcgccggattagaggcaactgttaatgatatcgcagagaacccgcacaacgtcaagatcgaggagctggcagcagagcaggttgcaagagtggctccggaggttgcattcgtcgtattaaacggtaactatgcattacaggcagggcttctccgttgcaaaagatgcattggcttacgaggcatccgattccgaggcagcgaagacctacgtgaacatcattgcagtaaaagagggacatgagaatgaccctggcatccaggcacttgtaaaagtattaaagtctgatgagatcaagcagtacatcaacgacacctatgacggagctgttatcccgtttgaggactaagcaaatagaggaaagaattgtcgaaatcagcatattgtgttttgtgtcgataagtaatattacgaacaatagatacttaaaagttccagataaacatgcggcggcaaattctgaccgcaaaatccggtatttctaaccatgccgcagctggcatcctcgatgatccgtgtctttccaagtttggagcactccacggactgtgtccgcaagccagcagacaattttagaacttttgtgtgtgtcccttgcggcaccagacaacagatggcataaatgccatctttatgtcgaacaaaacataaccgcgcgaagctgatgtttgaattgccatctgccatatttttaatagcagatggcaacgagtttcggttcgcgcggtttttatattgtctgtgaagaggtgccattagggacaccagaaagtccgctcattgtctgcggcttgtcggacacactccgtgagtgtccaaacgtggaagagacacggaatgggatgccagccacggcatggaagaaatacgtgaattttgcttcaaagaatttcccgccgtctgtttattctggaacttttttgttctctggtcttctaataatattacttatcatcccaaagcggtctatgctgattgcaacaatttcttttgcaatattttgtagaagaagagtttctttcggctgtatgttgtggtaaaataacagatataagctgggagtaaaatttcccggcaattacgaaggggaatggagagaagtaccatgaaagaggagcagaaagtatcatttattcactcaatttcagcaaagatcatgctgctgaccgtgcttgcagtggttatgtcggtgttgatcgtcgcattccgggcggaagcgggagcaaagaaggttgtcggagacgtcagtgcagattatattttaagcatggcggagatgggagtggagattgtgaacaatcttccacaggaggcggatgcaggagcatatgagaatgccttagcggatatcagtatggagggaattgattcttcctacgcctatcttgttgacacggacggcaccatgttatatcacccgaccgcggaaaagatcggacagccggtggagaatgctgtcgtgcttggcgtcgttgcagagcttgccaagggacaggtaccggtgaatgagacagtgacgtatgattttaagggcgttaccaaatatgcggcttacgcgatcacggcgaaccgtcagattgttgtggtgacggcggatgaagacgagatcatgaagccgctgaatcagatagtaagtaagattatgctgctgtcattggggatactggctgcagcgattgttctggcatacgtagtaagccagtttatctgcagaccgattcagcagattacaacgattattgtcgataccgcacagttggatttcagatcaaatccgaacggcgcaaagctgcgcagccgccgggatgagacgggagagatggcaaatgcggtacatgtgatgcgcaggaacctgcgttccatgattggcgatattgataccgcaagtaaccagatcacacagaatgtggatggtctgcaggagattaccaccacggtggatcacatgtgttccgacaactccgcgacaagccagcagcttgcggcaggcatggaggagacggcggcaaccacagtaacaatcaacgaaaatatcgaggttatcaagagcggagcggatgatattaacagtatggcgacggagggcgcacggacctcggaagcgatcatgatgcgggcaaatgatctacgcaccaagacagttgaggcaagcaccaagacaatgacgatgtacaacaacgtcaagacaaaggctcaggaagccatcgagggatcgaaggcggtcgataagatcaacgaactgaccggcacgatcatggagatctcatcccagaccggactgcttgcactcaatgcttccatcgaagcggcaagagccggggaggcaggacgtggatttgcggtggttgcaacggagatcggaagccttgcggatcagacgtccaaggcgatcaaggatatcggcacgattgtggatgctgtcaacgcagcagtttccaatatggcagaatgcttagaagagaccaccggattcctggagaataccgtgctgacggagtataaggaatttgagcaggtcagcgagcagtaccaggaggatgcggatactttcaagaccagtatgaacgacgtgagcgatgcgatggctggccttgccaattctatcgacgcgattgcacaggcacttagcggaatcaactctacagtgggcgagtcgtcgatcggcgtcagcgatattgcggagaagaccagcgacatggtggagaagacaggcaccacgcacgacatggtggaagagtgttatacttatgtggagaagctgcgtgagattgtgagccagtttgtattacagtaaataaaatatgatttgcagggaaaagggtatgcagatgttggagcgatgttgtgcatcggaatcacgtcggcataccctttttcacgcagacaggcataaacccgtccacattttcataggatgagttaacggcaaagcggtggacgtgctactttgtgggaaactcgatggatgggggcagcgcatatgcaggaatattatcgcggaaaaacggaagaacgagggagaaacgtgctcgaggatgaggagaaaaaatcctgggcggaaagttttctggaacagttaaacgatcctctgatctttatcctgtttgtggcggcggcgatctccctgctgctgcgggaatacggcgatatggcaattattctggctgtggtgctgttaaatgcgacggtgggagtgatacaggagggaaaagcgaaaaaatcgctggaggtgttaaaacagatgaccagcccgcatgcactgcttctggaaggggatgaagtgcggcagattccggctgccgatctgatcccgggcgatcttgtggtgctggaagccggctgtcaggttccggcggatcttgtgctgacagaagcggtgaacctgaaaatagaagaatccgcactgaccggcgagtctgttccggtcaacaaggatacggcgcagaaccgcatggcatatatgtcgacaaatgtgacctacgggcgcggcgtggggagagtatctgccatcggtatggatacagagatcgggaaaattgccgggatgctgaaggcggcgaaggtcgagctgacaccgttgcagaagcggttggcggacctcggtaaaattttgggcacggtgtccgtattcttatgtgtgctcctttttggcatggcaatcctgcaaaaacgggatgtgggagagatgctgattacggcgatctctcttgcggtggcggcggtgccggagggacttcccgccattgtgacgatggtgctggcactttccgtctcgcggatggtgaaggcaaatgccattgtaaagcgcctgccgagcgtggagacattgggatgtgtcagcgttgtgtgctcggataagacgggaacactgacacagaaccgcatgactgtaaaaaaatgttacgtgaacggcagagtgcatgcggtaaaagaactgcatccggccggcgaccggtattttttgcagggattttctctctgcaacgacgcatccctccacggaggggaacgccgcggcgatccgacagaattagcgctcttggatatggcggcagcgttcggcatacagcgggagacattggaggacaccatgccgcggatcgacgagattgccttcgattcagagcggaaacggatgacgacactgcatgagacgttggacggcagaatctctttcacgaagggatcgccggatgaaatcctggagcggtgccggtatgtgtggagcaacggcaagacggcggcgttttctgcggcggcgagagaacaggcaaaacggggacttgccgagatgacggaagcgggacttcgcgtgctggcgattggcatgcatcctaaagcggcacagatggaggagagcgggcttacgtttctggggatggcaggaatggaagacccggtacgccccgaggcggcggaggcggtggaacagtttgcacgtgccggagttcggacgatcatgattaccggggacagggcggacacggcgcttgcgattgcacgccagctcggcattgccgagcggagggatgaatgtgtgacgggcgaggagatggagcggatggacgaacagatgctggcggcgcggatcagtagaacccgggtgtttgcccatgtatccccggagcacaaggtcagaatcgtgtccgcatgcaaaaagaacggggagattgtcgctatgacaggggacggagtcaatgatgccccgtcgttaaaatctgcggacgtgggaattgccatgggaatggcgggaacggacgttgccagaaatgcagcagatatggtgctggcggatgacaattttgcaacgattgcaggagcgattgcacagggacgcagcatctatgaaaatatccgcaagtcggtgctgtttttgttgtcatccaattttggagaaattatcacaatgctggcagcagttgccatggggctggtatcgcccctaaagtcaagccatattctatggatcaacctgattacggattcgctgccggcactggcgctcggggtggatgtggaagaacagaaggattacatgaaccgtccgccgagacacagggatgagagcctgtttgcgggaggcggctggggatgcacctgtttctatggtcttttgatcgctggaatcagtatgcttgcctttttgcaggtgccggtcggtatgatcgaaggcgccgggatgacattgacacttccacacctgcaggcggtgcttaaagacgtgcaggtgttagcacgggcgcagacctacgcatttaccgtgctcggcatggcgcagttattccatgcggtcggcatgcgcgatgtggagacttcggtgttttgcatgaatcatctggaaaatcgtctgatgttggcggcgtttgtggtgggaattggtcttcagttgatggtcacggaggtaccgtattttgtacagttgtttggaacctgcagacttaccgctctggagtggacgaagctgcttggacttgcggcaatgccgctgctggcacatgaactgttggtgctgttttcctgcgcgggagaggtaaaggatgcgttaaggttgcagggagaggattgacaaaggcggcgtcggactgttatactccatacaatcttaaataacagaactgctaaaggggagtagttttaaattgcagcgtcaacatacgcggtcttggacctggcgctgtgtaccatgaagattacccgtggttatgagacttttagcgcggaaagtatcgcagagatacatttcgtgctggaagtctcttttttaattttaagaaaacaggaggcagaaatgaaagagtggtatcagatttcagcggaagaagtgaaaaagaagatggagacctcagaacatggactcacaacggaggaggcggcaaaacggctggcgcaatacggggagaatgtgctggtggagggaaagaaaaagagtgtttttgcggtttttttcggacagtttgcggatcttctcgtgggaattctgattgtggcagccgtgatttccgcctgttcggggaatccggagagcacctttgtcattctggttgtgatcgtgctcaatgcgctgctaggaacggtccagtatgtaaaggcggagaagtcgctggagagtctgaaggatctgacgtcgccgaacgcgaaagtgctgcgctccggcgtgaaggtggagattccggcgaaggaagtcgtgccgggagaccttctgctgctggaggcgggagacatggtggcggcggacggcagaatccggcgcagctattcactgcaggtggatgagagctcgctgacgggagaatcgacgaatgttgagaaaagagaaggtgtgatcgaacaggaggcggcgcttggcgaccgcgtgaacatggtgtattcgggaagtctggtgacttacggaagggcagaggtttttgtgacggagactgcgatgaacacggagatcggtaagatcgcaggacttttaagcaatgcgaaggaaaaaaagacgccgctgcagattgcattggatgattttggaaaaaagctgtcatatctgattctggctgtctgtgcgctggtgtttggtctgtccatgtaccgggatatgccgcttctggatgcgatgatgtttgcggtcgcgcttgcagttgcggcgattccggaagccctcggttcgatcgtgacgatcgtgcaggcgatgggaacccagaaaatggcgagggagcatgcgatcatcaaagatctgaaggcggtggagagtctgggctgtgtgtcggtaatctgttcggataagacaggcacgcttacacagaacaaaatgaccgtgcagaagatttatctggatcatacggcgatcatgccggaggcgctgcagatcaacgatcagcttcatcgttatctgatgtatgatgcgattttaaataacgatgcgcgcatggatgacgggaaagtgattggcgacccgacggagtcagcactgctcgagatggtgcggaaatgtggcgtggatgatgatttcttacggggagcaatggaacgacagcaggaactgccgtttgattcggaccgcaagctgatgagcacggtctatgcgctgcacggtgtaccgacactgctgaccaaaggggcgccggacgtccttttgaagcgcgcggtctatcttagggagaagcagggcatccggcggatgacggaggaagaccgtacggagattttagagcagaatcaaagattttccggggaggggcttcgtgtgctggcgtttgcttaccgggaactgaaagagagcgaggagctgacgctttccggggagtgtgattacatttttcttggacttgtggcgatgatcgacccgccgcgcgcggagtctgcggcggctgtggcagatgcgaagagagcgggaatccgaccggtcatgattacgggggaccataaagtgacggcgacggcgatcgcaaagcagattggcattttcggggagggggatatcgcactggtcgggcccgagttggacgccatgccggataaggagctggaccatctgatcggacacatcgccgtgtttgcccgcgtctccccggaaaataagatccgcattgtggaagcgtggcagcgcagggggagtgtggtcgccatgacgggagacggcgtcaatgatgcaccggcactgaaggcggcggacattggcgtggcgatgggaatcaccggaaccgaggtgtccaaagacgcggcagccatgatcctgaccgacgacaattttgccacgattatcaaggcggtcgcgaacggaagaaatgtctacaagaatattaaaaatgcaatcctgtttttactttccggaaatatggcgggaatactggcggtgctctacacctcgcttgcagcacttccggtcccgttccagccggtgcatcttttgtttatcaatctgctgaccgattcccttccagcgcttgccatcggtatggaaccggcggagagagatgtcctcagcgaaaaaccgcgcaatccaaaaggcggaattctggaaaggcgctttatggcgctgcttctggggcagggggcgctgattgccgtctgtaccatgatttcctttgaggtgggattgaaagagagtgcggcgctggcgagcaccatggcgtttgcgacactgacacttgcacgcttgttccacgggtttaactgcagaagccgtcactccattgtaaaaatcggattccggagaaaccggtacagtctgggagcctttgcgctcggtgtgctgcttttggcactcgttctgtttgtgccggcactcaaaaccctttttgaggtggagacgatgaatggcatgcagctgggctgtgtcggtgtgatggcggtgctgccgacgttcgtgattcagaacttcaaggtggtgggtgaagtgtttgacagagaaaagtaggaagaaacagcttgtgaaaacgttaccagtcctgtatgataaggaaaaaggatacagaaaatctgacagaaagaggggcgtttggatgagacgaagaggaaagagagaactggcggcactgctggcagtggcgttgcttgctggaagtgcggcgtgcggagcggatgccggggagaaagacgcggcaacaggtacggcggaagcggcagccgggcaggacacggagacggcagccgggcagggcacggatgcgcagacgggagcacaggagaacatggaagagacggcgctgtctctgatgcgggaggtaaacccggcagaagctgcaggaacggatgatctctaccggagctggtacgaggtgttcgtttacagcttctatgacggcgatggggatggcatcggagatcttccgggactgacggagaagctggactatatcaatgacggtaatccggcaacggatacagatctgggatgtgatgggatctggctgatgccggtgatgccggcgacgacttaccacaaatatgatgtgacggactactgtgcgatcgatgagcagtatggcacaatggaggatttcgagacattcgtgaacgcatgccatgagcggggaatccgtgtcatgattgattttgtgatgaatcatacttcgtctcagcatccgtggtttcagacggcggcagagtatctgaaggatctgccggagggaatggagccggatacagaggcatgcccgtatgtggattattatcatttttccagggagaaaggcagcggatactgccagctggcagggacggactggtattatgaggcacagttctggagcgagatgccggatctgaatctggagagtgaagcggtgcggcaggagtttgatgagattacagacttctggctggaaaagggcgtagatggtttccgtctggatgcggcaaaagagtatgagaccggaagcatcgactcgaacatagaaattctatcctggtttaataatatggtaaaagaaaagaagagtgatacgtatattgtgacagaggtgtggtcggatctggagacatacgcacagtattaccagagcggaattgacagcagctttgactttacgtttgcagacaaggacggtgtgattgcgaaggcggtcaagggaacgagcggtgcctcttcttacggaaaagcgatcgtgcggctgcaggacgcgctgggaacttacagtgacagctatatcgatgcgccgttttacaccaaccatgatatgggaaggggcgcagggtattactccggcgatactatggaggcgcagaccaagctggcgcaggcgatgaatcttctgatgtccggaagcagcttcttatattatggagaagaactgggaatgaaaggcgccggaaaagatgagaacaagcgtgcgccgatgtactggagcaaggatgccggtgcagaggggatgtgtctcggaccgcaggatatggatgcgatcacgatgatctatgacagtcttgcggagcagcaggacgacggcaattccatctactggtatgtgaaggaggcgctgcgtctgcggaatgcttatccggagatctcgcacggaacggcagagttccttgaaaatctgtcggatgatgcagtgtgcgtgctgcgcaagagctggcaggattcctcggtgatcgtcgtgtttaactgcacgaaggacgagcgcaccgtggatctgtcacagatatctgcagacagtgaaagcggggatttgaagctggcaggagaactgctgaccggaatccgtgcggcttcctggcaggatggaacgctgacgcttccggcgtacggtgttgccatcctgaagtagagatctgaaaaaacaatcagccgctctgctgccggcagcatcaggagagaaaacgatcagtcgttataattcagaagaaagtccgcaaactgtaaggcggcgtctaagttctgattctgatagagtatgccgaaatagcaggaatcataatagttgtacttgtgaagccaggcattgtcggtgagctcgatcgcacagggataggaagcgacggcaccgtcctcggtcgtgtagatgagatgatcctggtagcggtccagcagttcgtcggataatacggtggacagatccataagagctccctggttggcgtaatcgagatattcgccgccggttccgaagaagagatcctgtccgccggctgccagcatcagcgtcagcacctgcgtgtcgttgtaggacgtggaatactcgccgtccgagaactgtaaggacgatgtgagggagacggaatcttccttcgggtcgtagccgcaggcttcgagaaattcatcgaagcccttgctgtcggcggttatggaatcgttgcagttcatcatgatgacgtttaacagcgggtcgcggtaggtcgcgtaatgatagatgaggtaaatgacaaagcagagcgcagcgatcgcagcggcgatcggccacttgtaataatcccagacatactgcactttcgccttgcgggaaagtgaatgaaaatcagcctttttctccataatggtactccgtttctaaaatgaactagtacaagaataacatagaaatggaaggttaaaaaggaaaaaagaatgaaaaaattataaaaaaacagagcagtgagagaatctctccatctgctctgttctttttcgctctccaattaagaaaagcgggtgatgggaatcgaacccacgtatccagcttggaaggctggtgttctaccattgaactacacccgcatgaagtgcccagttccggaatcgaaccagagacacgaggattttcagtcctctgctctaccaactgagctaactgggcgtctcacagaaatttattttacaggaaagccattaggatgtcaagaaaaaagttttgtaagaatcttaaatttttgaaaaataaacacaaaaggtcttttcgggaaaagggatacatgctaaaatatagcacagtgagcagtttttggaaggaagaggcgcaggcgggatactgcgcggaaagaggttttacatgcacgagaaattagtgattgttccgagaaagaaatctacggtgaagaagattttaaacgtggtatggtttgtgttggcatgcctgtgctttttatttgcgatgtgggtgccgattttatttgcggtgccggcaattatttttgccatcatctggtattttcaggcattccgctctgatattgagtatgagtacacctattatgacggagagttccgtttcgcgagaatcaaggcgaagcgcaagagaaagggacttggaagagttcagatggaagatgtccttgcactggcaccgaagggggaccggagtgtatacaagtatgagaatgataattctcttgcctgtaaggatttgacttccggcgagagcggcacgaagatttacgaactcgttttcaaaggcgagaagggaatcaaccgctatgaatttgaaccggatgaggagatgctcgacgcagtcatggtgaagtatccgcgtgcggtcataaagtagaaaacaaaaaaggtggcccggatcggtaaagcgatcgggacacctttttatatcatatatgatgaatcaggacagatccgtggatcagtcttcaatgaaacgcatccggctgtctgagatatcctcacgggcagaggagtgaatggagacatccttctggcgcatgcatttggcacataaagtcccgaaagagatcggtgcgccgcatctggtgcagtgcatggtaatcgtgttcagatggtcatccttgtactcaatgcgcccctcgcggatccactttttgacctgcatatgcgggatgtggaagtgctgtgcgacatcgtattcatttacatcgttctcacggatgtactctttgacttcgcggaagagcttctgctcgatacacgacgggcagagattctctttatatgtcaatggaagcggtcgtttgcattcttcacaatatttatagttcccaaataaatcctgtggttgttccatcgtctgtcacctccggtagtatgctgccacatccgtccgccgcatgcaggcatgggcgttcgtctttactccatgttcactgtttatagattcattataccatgaacgacggtgaatgaaaactttttatcacgtagaaaagaaaagaaacttagcagaagcttagcggggaggaaacgatttgaaactgtttcatttgtcggatcttcatataggaaaacagctgcatcactacaatctcgcggcagagcagcgcaagacactggcgcagattgtggcgcttgcaaaaagcgagcacccggatgccatcctgattgcgggagatatttacgacacaccggtgccttcggcggaggcagtgtctgtctttgatgcgtttttgtcggcattatgcgagatagagccgcagattgcggtcatgatcattgcggggaatcatgacagtgcaagaagaattgattttgccagcagtattcttgcaaaacatgaggtgtatatcgcgggacttccgccgatgcaggagggggagacgatccgccgcgtgacgcttgcggacggatacggtgaggtggatttttatctgcttccgtttgtgaagccgggttatgtgagaaagctgtttgacgaggaaataaaaggctatgacatggcggtaaggcgcctgattgagcgcgaggagatagatccggcgcggagatgcgtgatcctgtcacaccagttttatacggcgggcggaaaggagcctgcgacctgtgactccgaaatccactatgttggtggcgttgaaaatgtcgatgccggcgtgcttgcgccgtttgactatgcagcattgggacatatccaccgcgcacagcatataggagcggaaaaataccgctattgcgggacgccttttccgtattccattagcgaggcgggggaggagaagagcgtgacggtcgtggaactgggagccaagggacagccgcccgtgatccggcagattccgcttacgccggtgcgggaggtaaaaaagctgaccgggacgctgcatgagattttggagcaggcggggcaggaggtctgccacgcatttgtgagcattaccctcacggatgacgtggaggcgttccagccgaaggagcgtctggaggaaaaatacgaccacatcctggagatacggattgacaatgcgcggacgaggaagctgttgtcggacacggaagagcagcttgccgaagtgcggccggaggaggcgtttgccatgttttttgcggagatgaacgggagagagatgacgcctgaggagcgggaactgatgcgtcaggtgattgcgcaggaaatggagggggacgaatgaagcctgaaaaactcatcctgtcggcgttcggatcgtatgcgggacgcacggagattgattttacggtgcagacaggcggactatttctgatcacgggggataccggcgccgggaagaccacaatttttgatgccatcacctatgcgctgtacggggaggcgagcggcggaggcagaagcggagccatgatgcggagccagtatgccaaaagtgtgacggagacctatgtggaattctcttttttgtatgcgggcgagtcataccgcgtgcggagaaatccggaatataagatcgtaaaagaactgaaaaacggaaaactgcgggagcagaaggttctggcagttgtggaactgacgctgccggacggaacggtgtatccggaaaaaaggagccagaccgatgcgaagatcgaagagctgatcggactgacaaaggagcagttcacacagactgccatgatcgcgcagggcgattttttaaaacttctgtatgcaaagtcggacgaccggaaaaagattttctccaaattgtttcacacggatgcatactggagaatccaggagaacttaaagcggcgttcactggagatggaccgggtgcttgcggaaaatgagcgggctgccgagcaggagagggcgcgcgtgattctgccgcgcgaagaactgaaagaacttccgcttccggaagcggtggagcagatcggtatctgggagagggagctgacggcttcacaggagaccgtgcgggaggcgatacggaggctgactgcggaaatctctaaggcgaaggaagtcaatgaactgtttgaagggttaagagactgtgaacagcaggtacagaagttaaaggaagaagagcccgtggaagcgcgccggaaaaaacagctggaggcggcagtacgtgcggagagggtgcatgtgaaggaattgcgctgcaatgagcgtctggatgagcggcggcagtccgacgagacggtggagcggatgaagagccttatcgcggaggaaaaggaagcacatggcaggcaggagcaggactttaatacgcttaagatgcagagcgccgatgcggcggaagccgacgcggagaaaatgctccgcatccgggaacagcttccggtgtatgagcgcctgggagaggcagtagagcgggaacagcaggcaaagcaggcgtacgagtcggcgaagcagtattatgagcgtgcggtgcgggaaggagccagccggctgctcgcggaaaaaaacaggcagcttttgctcgaggaaaagtatgtcagcgccgcaaaagcgtgggagcgggcatccgcccggtccacggaggcgtctgcggaatatgagcacgtgtaccagctgtttttaaaggaacaggcgggaattctggcacagaatctgcgggaggcagagccttgtccggtctgcggctccctgacacatccgcatccggcgtcccttgctgagaatgcggtcagcgaagcggcggtaaaggcggcgaaggaacagcgggagcaggcggagacggcgcgcgatgctgcgtatcaggaatttgacgggcagaaaagcgcggcggcagagcaggaactgcgtctggagcaggcgaagcagcagttcttggcgcttgcgggagatacgtgcggtgacagagagaaagaactttatacgtttgccgcacagcaggcggcagaagaacctgcagcaaaaaagaggtctctgacagagcgtggacggcaggcggagcgattttcacgggaggggaaaaaacatcccggggaaacgggagaggcggtggaccgcctgaagcttgagtcgctcaagcgcgactgggaagaagaccagcgggaaacggcacggatccgcgcagagttatcatttgagacgaaagaaagggcagaggaagcgctgcagcagctgacggatgaggcagaccggcgtacgaagcgccttgctgatgcagaggaaacactgcaaaagaaaaaggaagacatttccagacaagagggaatgctgacgcaggagcagacgaagaatgccggacttgtgcaggagtgtctggaattggagaaagaataccggcaggcgctgcgtgatgccggattttcttcggaggaggcataccacgaagcattccttacagagagcgggcgggagacgctcgtgcagcagtctgaggcatacgtccggaatcgcgtggaaagtgagggcaggcttctgactatgcagaagctgaccgagggaaagcaggagattgggatcttggcatgggagacggaactggaggcgcaaaaacagcgccagcaggagcttcatgaggagattcttgcaatgcacaccgcatacgagacggatgcgaaagtggtggagcgctgcagggaatatttcgccgcacacgagcggctcgatgcggaaaaccaggtgctgaaaagactgtactgcacggcggatgggcgcctggcgggctcggcgaagattgattttgagacgtatgtgcagcgccggtatttccggcaggtgatctacgaggcgaacagacggctattgacgatgagcggacatcagtttatgctaaaactgaaagagacggaaaacagcggacgcaaatccaacgaaggtctggatctgtcggtgtacagtctggtcacggacagtgagcgcgatatccgtaccttatccggcggcgagtcgtttctggcagcgcttgccatggcgctgggactttcggatattgctatccgcaaggctggggccgtgcatctggacatgatgtttatcgacgagggattcggtacgctggatgcgcagtccagaaaacaggcgattgaagtattgtcacagctcgcgggaagcgagcgcctggtgggaatcatctcccatgtgacagaattaaaagaacagatagaacacagactttatgtcacgcgcacggagaacggaagcgaggcagtctgggaggaatagcagtggaaaagtatgaaaacagacaggaatgtccgattggtgtgtttgattcgggagtcggaggaatcagtgtgctgcgggaactggtggcacagatgccgaacgagaattatatcttttttggggattctaagaatgcgccctacggtacaaagacgctggaggaagtgcagaagctgacctgtgcggatgccgaatatctgctgtcacgcggcgtaaaggcgctcgtggtggcatgcaacacggcgacaagcgcggccatccggatccttcgggaaaaatatgcggatatgccggtaatcggaatcgagccggcattaaagccagcagtgcacgcgggcggacacccgcgtgttctggtcatggcaacaccgatgaccctgcgcgaggagaagtttcacgccctgatgcagcggtttgagtcggatgccgagattctccggctgccgtgtccggggctggtggagtatgtggagcagggcgtgctggagggcgcagaactcgaagcgtttcttgcaaatctgtttgaaccgtaccaaagccatccggtggattgtgtcgtgcttggctgcacgcattatccgtttgtgcgggagacaatccagaagcttctcggagccggagtgcagatctttgacggcggagcggggaccgcgcgggagacagaacgcaggcttaaggattgcggtctgtgcagtggcagagcgcagcaaggaaccgtggaattgtgcaacagtcttgcgtcggagcagatgaaacagctggagatccggctgctccagtcgggcacggtgcaggcaattataaaaaaatagaaataaaatattaaagaaatctaaataacattgaacgtttttttagaaagctttatgaaaatcgacatacttcggacacattttttccgtatactaacatcatcgaaaggagctgaggacggtttcccagagcttcgttcccagcagctcagagatgtggaataaaggtcatatttctgcagaacctttcggtgaagattcctttatatagattaacattttcataactaaactcctcgaaaaacccccgggacagagatgtcccgggggtttttcattggggggaacatacaaagaatgtaaaatgcagtttttatatgttgaacttactatgcttgtgatataatgaatcttgacagattcatattagaagttcctgcggaacttcagatgcgcagaaagcagcgcaaaaaaagatgatatattcgctggaacgccggcaggcacaaaagagagggggacgctggtggtagaagataaggtgacggggaagcgtatgattgctcacatcaatgcgagcggaaagattcagacagtaaaaagccattctgaggggaccgcatgtctgacacagcagtttgcggaggagttcggttgtggaaaacagggatatttttgcggacttcttcacgatattggaaagtattccgaggcatttcagaggcggattgcggatccggaacacacggcaaaggtggatcattcgactgcgggggcggttgaggcgatgaaaatagcaaaagaaaacataccgcttgcaatgacgattgccgagcatcattctgggttgttgaacggaggcgtctaccggatttccaataaaggagacggcacgttttttggaagaataaaaggagcggaaagtctgccggattatgcggcatggaagagagatatcgtaccggaggatgtgaatattcctgcattttgtagggatggaagcaatccctgttttacgatgtctttttttattcggatgatgtattcctgcctggtagatgcggattatctggatacggaagcgtttatgaaggagaatcaggcagtcaggggagaatatgattccctgaaggttttggcagaacgttttgacaaccatataaaacaatggctggaaaaaacggatttcaaaagcgacaaacagaaaatactctgcagtataagaaatcaggttttgcaggattgtatgagcaaaggaagtgaattgccgcccggaatctatacgctgacggtacccacgggaggcgggaaaaccacggcatctttgggctttgcactgcggcatgcgatacaatcaaagatgaagcggattatttatgtgataccgtacacatcgattatagaccagaatgcagaggtgttccgctctattttaggagagaaaaatgttctggaacatcattccggaattctctacgatctgacggaggataaggcggagaatgaagcggcataccgcaaggctctggccaccgaaaactgggacatgccggtgatcgtgacgactgcggtgcagttttttgaatcgttgtatgcgaaccgcagttcaaaatgcagaaagcttcataacatggcaaacagtgtcattatttttgacgaggcacagacaatgccgattccatatctggaaccgtgtgttgcggcaatcgcagaactggcggcgcattaccattcaacaatcgttctttgtacggctacgcagccggtattggatgaaatgatccaaaaatatataccgcagacgcaggtaagagaaatctgtgaacatacagatattctttttcaaaaactgcgcagaacatcgattgttgcagccggcaatatggaacgggaaaaattgatcgactgtctgactgcgcaggagcaggtgctttgcattgtaaacagtcgaaatctggcacaggaactttttgaagaaattccgagagagggagcattttgcctcacaacattattgtacccggagcatcgcaaagagaaattgcgcgagatcaaagagagactggaacatcatgtgccctgcagggtgatcgctacttcacttgtggaggcgggcgtagatctggattttccgtgtgtatatcgtcaggagaacggactggatgcactcatacaggcggcgggcagatgcaaccgggaggggacgcattccccagaggagagcaaggtatatctgttcggtttgaaaggcgatgcatcggtatattttgcacagaacatcagcgcgttaaggcagaccctgcgttgttacgaagatccggcagcgccggaggcgatcgcattctattttaagcagtatcgtgagattctggggagagagaatctggatcaaaagaagataatggatgcatttactgccggaaaaggaatcaatggggattgctttccgtttgcaacggtggcaagggaatttcatctgattgagagtgagacacagacgatttatattccggtcggtgaagcggaattgtggatagaggagatggaaaagggaaaggtctcaagagaacttatgcgaaagctggggcagtatgcggtgaatgtatatccgaatcatttaaaagcattgtacgatgccggctgtgtggaaggaatcggagaggggatgtatgtgcttcgggatatgaaccagtatcatgaggataccggacttcagatggatgtgagtacaggatatggattgttcggataaaagagtggtcaaaaggcggcagaaatctgccgccctgatgaaagaaaaacatattaaatatttcaatccacacttataaagtgacaaaatcagtgtatacaaatataacgtttttttcaataaaaaatgtattgacaaacataataatatattatattgtataaatactttaaaacatattaaatgaaaaaataaatgaaaggaggaatgatatgtggcagtaaaaatggaagtgtgggggaattttgcatgcttcagccggccggagatgaaggtggaacgcgtcagctatgatgtgatgacaccgtcggcggcgcggggaatgctcgaggcagtatactggcacccaggcctgcagtggcatattgacaacatttatgtgttggcgcctattcagatgacaaacatacggagaaatgaggtgcagtccaaggtgctggggagcagtgtaagagcagctatgaccggcggacgcacagaactgtatattaacacatcaaaggatattgtgcagagagcatcattggttctgcaggatgtcagatatgtgattgaagcacattttacccttacagagaaggcggcagccggagataatccgggaaagtttcaggatatcataaagcgccgcctgagaaagggacagtgctatcacgaaccatattttggatgtcgggaattcccggcgaatttcaaggagtgggagggcggagagattccggctattcaggagacaagggatctcggctatatgttgtgggatcttgacttctcagatccggcaaacattcgtccgctgttctttcgtgcaaagatggaaaacggcgtgatccatgtggcagattgcgaggtgctgcgatgattttacaggcattggtggaacattatgaagatttgttgaagcaggggcggattgcaaagccgggttggggaaaagtaaaagtttcctatggactgaatctggatcggcagggacacgtactagggttgatcccgttgaaggtggcgcaggagacgggaggcagcaagaaaaaaacggtttttgttgcgcggatgatggaagtacctcatccggagaagagatccgtggcggtttgcccgaactttttgtgcgacaatgcgacctatattcttggtgttgatgaaaaaggaaaaccagagcgaaccagtcagtgctatgaagcctgcatggaaaagcacatggaattgctttctgatatccacacgccggcagcagaagcgatctgtcattatttcgagtattggagcccggatgcggcgcgccagtgtactgacatagaggataactggagcgatctgatggcaggagtaaatcttctattttattatgaaggagaagcagtgacagaggatcctgcaatacgtgaagcatggcagcagttttatgacaggaaggatgaaagcgggcagacgttgtgtctggttaccgggaaaaaagacaagcttgcagtgctgcatccgagcattaagggggttcgcggcgcacaggcgatgggagcgtcactggtatcttttaatgcagcgtccttctgttcctatgagaaggaacagggtgccaatgctccggtgggtgagtatgcggcatttgcctacaccacagcgttaaatgaacttctgaatgaccgggctcacacgggaactatcggggatacaaccgtggtatgctgggcggaaggaggagagagcctctatcaggatgtcggtatgatggcgatgttcggtctgacagatgagagtggtatgacagatggcgaacttcgggcaattatcgggaaggtggcaaacggggagccggtacagatcgaggatatacgactggatcccgacagacatttttatgtgctgggacttgcaccgaatgcggccagactgactgtccgattttttatgagggattcttttggcactatgatccggcatgtcaatgaacatcaggagcgtctgcggattgttaatgcgcggcaaaaggagtatcccatcattccaatctggaaattgatgtcagagaccgtaaaccaaaatgcgagagacaagtctccgtcaccacagatggcagcggatacgctaaaagcggttctgacaggcggaaagtatccggcatcgctgctaaacgccgttatgttaagaatccgggcggaacacaggataacacgagagcgagcggctatgataaaggcctattatctgaagaatgagaacaaagactgtcccaaggaggtattgcaggaaatgataaatgaggagagcaaaaatgtaccatacacactggggcgcctgtttgcggttttagagcatttgcagcaggaagcgaatccaggaattaacacgacgatcaaagacaagtacttcaattcggcagcagcgaccccggcacagatttttccgctattgctgaatctggcgcagaagcatctgcggaaactggcaaacgaaggacacaaagtttattttaaccgacagattgggaaacttgcggaagtgattggggagagtttcccaaagcgtttaaatctgccggaacagggagcctttcagctggggtattattgccagacacagaaacgatatacaaagaaggaggaaaactaagatgggagaggcaattaggaacagatatgattttgtagtactatttgacgtggagaatggaaatccaaatggagatccggatgccggcaatatgccgagaattgatccggaaacgggttacggtctcgtgacagatgtgtgcctgaagcgaaagatccgcaactatgtggagacactcaaggaggatacgaccggatataaaatctatatcaaggacaatgtgccgttaaaccgcagtgatcttggagcattccagtcacttggcattgacgaaaaggagattaagaatttaaagaagacagatccaatgctggacgtaaaggttcgtgactttatgtgtcagaatttctatgatattcgtacattcggagcagttatgaccacttttgtgaaagcaaatttaaactgtggacaggtacgcggaccggtgcagatgggatttgcgaaatccgttgatccgattcttccacaggagatcacgattaccagagtggcaatcacgacggaggaggatgctgccaaaaaaggaacggaaatgggaagaaaatatattgttccgtatggtctgtaccgggtagagggatatgtgtctgcaaatctggcgagaaaagtgaccggtttttcggaagaggatctggaattgctctggaaagcaattctgaatatgtttgagaatgatcatgcggcggcacgcggcaagatggcagtcagaaaactgatcatttttaagcacgacagcgaacttggaaatgcaccgtcttataaattgtttgaagctgtcaaggtggcaagaaaacctggagttgatttggcaagggcgttttcagattatgaggttacattgccggagcagctgcctgagggagttacctgtacctgtatggaatagtattgcgtggctatcgcagggagaaacatatggaatatcaggaggaggattatttattattatcgggaattcagcatttcgttttttgccgcagacaatgggctctgattcatattgagcagcagtgggaagagaatgtacggacatttgagggaagggtcatgcatgaaaatgcgcacaatgcggactttcacgaaaaaagaaacggggttatcatggtgcgggcgatgaaggttttctccagagagatgggaatcagcggagaatgtgatgttgtggagtttcatccggcaccggagggcatcacattagctggacaaaagggaacgtacattgccgtgccggtggaatataagcgcggaaaaccaaagccgcacaatgcagatgaaatgcagcttatggcgcaggcaatgtgtctggaagagatgcttatgaccagaattccaaagggctatttgtattatggagaaacgagacgcagaacggaagtgctgtttacagaggaattgagacagagtgtacggtcttgttttgaagaaatgcatgcatattacagcagaaaatatacaccgatggtaaagacaggcacatattgcaggcagtgttccttaaacaacatctgtctgccggaactttccggagcacagcctgcggatgcctatgtgtcggagatgttaaaggaggaattgcaatgaagaaattgctgaatactctttatgtaacaacaccggatgtatatcttgcattggatggagaaaacgttgtcgtcaaaaaagaggatcgggtggcaatgcggataccgattcacaatgtagaagcaatcgttgcgtttaattatgtaggtgccagtccggcgctcatgcgcaaatgcaatgagaacaatgtgaatctgagcttttttcacaatgattcgttttgtgccagaatgatcggacaggaaaacggtaatgtcgttttgcggaaaatacaatatcggctgtcggagcgggaaggtgaaagtcttgcgattgcaagaaatatgattctcggaaaggtacataatgagcgttatgtacttgaacgggcaatccgggatcatgcattgcgccttgatacagaaaagctaaaagatgcgtcggagcagttaaaacagtatctaagagcggtgaaagacagtggtagttcggaggaactgcggggatatgaaggaaaagcggcaagcacttattttagtgtatttgatgaactgattcttcagaacaaagagagcttcgtatttcacggaaggaataaacgtccaccgctggataatgtcaacgcaatgttatcatttacgtatgcgctgctggtaaacgagtgcgcaggcgcagcctattcggtcggacttgatccttatgttggatttttgcataccgaccgtccgggaaggcagtcattggcgttagatctgatggaagaattccgggcacccgtggcagaccgttttgttcttacaatgattaacaagcagcagatcaatgcaagagggttcagaaaaatggaaagcggagcggttgttatggatgatgacacacgcagagtgctgatacagaactggcaggaattaaagagtgaagagatcatgcatccttacctaaaagaaaaagtagctgtcgggctgctgccatatgtgcaggcgatgctgcttgcccggtatctgcggggagatatcaatgcatatccaccatattttaaacggtaaagataaactgtatgctgtttggaaggaaggtgagttatgttagtgctgattacttatgacgtgaatacacagactgcggcgggagtacgaagacttgcccgggtagcgaaaatctgtacgaattacggacagcgggtacaaaattctgtatttgagtgcattgttgatcagacgcagtatgtcatgttgaaaaagcagttgaaggatatcattgatgtggataaagacagtgtgaggtactatgtcatgggggaaaagtataagagtaaggtggaacatatcggtgtgcaaagggcatttgatgtcacggcgccgctgattatctgagagtttttagagtagtgcgaatgtaaagtgtacataaatacagcggaacattcgcgcacaatttatcagtgcaaatagcacaaaatcaagttatcgtctgtggaaaacgtgaaagagtaaaggaatttttggaagaaagcgttgaaaacaggaggtcacaaaggaattttatgtgtatatttgctgtcgctccctgtgaggggagcgtggattgaaattactacgggcgccgctattggacttgtgttcatgtcgctccctgtgaggggagcgtggattgaaatcctggtcttaagtggcaagatacatacttgatcgagtcgctccctgtgaggggagcgtggattgaaatgctataccggcacacaggtgctcactccacagcgagtcgctccctgtgaggggagcgtggattgaaatgctaacgctttagttgagcagatcatggagcagagtcgctccctgtgaggggagcgtggattgaaatacggcattgcacggcgtaagaatggcatgtacgggtcgctccctgtgaggggagcgtggattgaaatgtctggatggtaatctcttttatacatattatacgtcgctccctgtgaggggagcgtggattgaaatagatgtagagctggcacagacggacgcaaagtatgcgtcgctccctgtgaggggagcgtggattgaaatattgataatagagacaatcttatcgccaatattcgtcgctccctgtgaggggagcgtggattgaaattcataatatccataaaaccgccccccctatgcttcgtcgctccctgtgaggggagcgtggattgaaatatcaagccatttttccatgtttttcttgtctggcgtcgctccctgtgaggggagcgtggattgaaatgctcactctttttttgatgactcttaccatgatggtcgctccctgtgaggggagcgtggattgaaatgcataaccataatccttgtactcctcgcgcagctgtcgctccctgtgaggggagcgtggattgaaataaaaaatgatgatgacggattccaacgcagcaatgtcgctccctgtgaggggagcgtggattgaaatgctaacgctttagttgagcagatcatggagcagaggtcgctccctgtgaggggagcgtggattgaaattgttataaagtgacctaaacgtttagctcctgtgagtcgctccctgtgaggggagcgtggattgaaatctgcgagcagggtcgacgagcacatcaagacggagtcgctccctgtgaggggagcgtggattgaaatccctgattccattgaaagctaatgaacaggaaacacgtcgctccctgtgaggggagcgtggattgaaatatgcagatgattgatatggaagcaaaggttgaggtcgctccctgtgaggggagcgtggattgaaatataggaattcatgtggcttttaacgctttcttcgtcgctccctgtgaggggagcgtggattgaaatcgctatatgcctagcttgtgccgccgcttcgatgtcgctccctgtgaggggagcgtggattgaaataaaacttaacgtcgattcgccgttcggttcgtcgtcgctccctgtgaggggagcgtggattgaaatctgtcgtgtgcattttataatggacgtttggacaagtcgctccctgtgaggggagcgtggattgaaatatattatctagattggttactccatctttgacagtcgctccctgtgaggggagcgtggattgaaattcaatctgctgaatccgctgctgaattgcagatgtcgctccctgtgaggggagcgtggattgaaatcatattccgacattgaggatgacaggcttgtggtcgctccctgtgaggggagcgtggattgaaatagtctattgcagacgattttgacggcttgcaagagtcgctccctgtgaggggagcgtggattgaaataacctgctcctcgtcgttatcctgtggcgttgtcgtcgctccctgtgaggggagcgtggattgaaatgattgaattatctctttgataactccaaacgccgtcgctccctgtgaggggagcgtggattgaaatagaagttataggtgctggcaagatttaccgtgtctggtcgctccctgtgaggggagcgtggattgaaatatgttgtccaagttggttactccgtctttgacagtcgctccctgtgaggggagcgtggattgaaatatgcagaggtattcatcccagtttgccgccgcaaaagtcgctccctgtgaggggagcgtggattgaaataaatagcgtcatacgtgacaagctacgcccgtttgtcgctccctgtgaggggagcgtggattgaaatcatgtacataatcgaccgtaacatgagtttgttttgtcgctccctgtgaggggagcgtggattgaaatcgagatcgacggagatcgtcacgtttgtctgatcggtcgctccctgtgaggggagcgtggattgaaataaggtttccgtcagctattgcctgtgcgatctccgtcgctccctgtgaggggagcgtggattgaaattccgcctccgagcatcttaccgcccatctgtccggtcgctccctgtgaggggagcgtggattgaaatcttggagatgccgcagttcttcagaatagccatgtcgtcgctccctgtgaggggagcgtggattgaaatctgtcggcgcagaattccagggcgtcttatatggtcgctccctgtgaggggagcgtggattgaaataactcatcgccacggagcacgccagaccctaacgccgtcgctccctgtgaggggagcgtggattgaaatactaagcgcaagttctgacagccagtacgccatcgtcgctccctgtgaggggagcgtggattgaaattatggctccatgcatcatccattgcccgatgcccgtcgctccctgtgaggggagcgtggattgaaattttcagatgtttgcggtgtttttccgtgagtccaagtcgctccctgtgaggggagcgtggattgaaattgatgcacctatccgatacaattcaccaaagaagtcgctccctgtgaggggagcgtggattgaaatttgcgcgcctacggtgtaagtctaggcgttatcagtcgctccctgtgaggggagcgtggattgaaatgcccgtcttggtctgcacatacacgcagtcacgatgtcgctccctgtgaggggagcgtggattgaaatgccccagtttgcatcaagtaccacccaggagctgtgtcgctccctgtgaggggagcgtggattgaaatacattgtcaatagcaagatcaagacgagtcacagtcgctccctgtgaggggagcgtggattgaaattgtcgaaagtgtttgtgaaatataagtttaatcggtcgctccctgtgaggggagcgtggattgaaattgaccatccggcatctgttaccttgttcttcacacgtcgctccctgtgaggggagcgtggattgaaatatggcaaacgtaagaaatcagatcaatgactactggtcgctccctgtgaggggagcgtggattgaaatgatctgcttgtgatgtgttgttaccgtcgcttgtggtcgctccctgtgaggggagcgtggattgaaattccctcttctgcgttttccgctgcgagaccgtatatgtcgctccctgtgaggggagcgtggattgaaatctcattgattgatgcttttaggtgtaatccaatgtcgctccctgtgaggggagcgtggattgaaatataatttaggttatgaatttatgtttgtaaaggatgtcgctccctgtgaggggagcgtggattgaaataaaatactccatgtcagatgccgacagcacggcgtgtcgctccctgtgaggggggcgtggattgaaatgcatttaaccgtccatagtttcccgcgtcataagtcgctccctgtgaggggagcgtggattgaaatccgtttccaagtttggggagctccgaagctgttgtcgctccctgtgaggggagcgtggattgaaatatatactcccatgccgtttctcatgtttgcaacagtcgctccctgtgaggggagcgtggattgaaatattttcttgtcgcatacaaggtcaatggcgttgtcgtcgctccctgtgaggggagcgtggattgaaatatctactgtgtagtgaatttccgttccgcaaggtgcgtcgctccctgtgaggggagcgtggattgaaatattttgaagatatagagtggttatgcggatatatgtcgctccctgtgaggggagcgtggattgaaatcgccatggcgaagcaatatcaagtggcgcagctatgtcgctccctgtgaggggagcgtggattgaaatatctgcaatttgacttgcgtatactatttccaagtcgctccctgtgaggggagcgtggattgaaattatgtatttaattatcattagcaccaccccttttgtcgctccctgtgaggggagcgtggattgaaatatatcttttacaaatttaacttcactatgatttgtcgctccctgtgaggggagcgtggattgaaattgaaggattttttaaaattcccgccacaaaaatcagtcgctccctgtgaggggagcgtggattgaaattttgaattgaaaaaatacactgcattgcagatcggtcgctccctgtgaggggagcgtggattgaaatgtcgacctgtacttcaaagtttccatcgcacgcgcgtcgctccctgtgaggggagcgtggattgaaatttgatcggatatacaccaaaaagaagcatctttgtgtcgcttcctgtgaggggagcgtggattgaaatatcacagatacaggcaaagcaccaagggaatagtgtgtcgctccctgtgaggggagcgtggattgaaatatcacagatacaggcaaagcaccaagggaatagtgtgtcgctccctgtgaggggagcgtggattgaaatcccttgctacaattataaaaacagcggagctacgtcgctccctgtgaggggagcgtggattgaaatcgcagtggctgccgggacaggagataactgtggcgtcgctccctgtgaggggagcgaggattgaaatacgaattacatgaaagagggcaagtcattatttgtcgctccctgtgaggggagcgaggattgaaattttgtagtgttcccggactccacggtcgcaactgtcgctccctgtgaggggagcgaggattgaaatcattggatatgtggagcagaacatggatttcacggtgtcgctccctgtgaggggagcgaggattgaaattttttaaagtgatatgatagtatcaacaagaaaagtcgctccctgtgaggggagtgtggattgaaattaatatcagtatgacccatttgcgtttttattagtcgctccctgtgaggggagcgtggattgaaattggaagaagcaaccacgatcaccgatattctgggtcgctccctgtgaggggagcgaggattgaaattttacaacgatctctcgttgtattgtttggttttgtcgctccctgtgaggggagcgaggattgaagtagtcagatggctgatgttgttgcccgttctggatcgctcgcagcgaggaaagtgtggattggaaggttgatctcagcttggagacaggcgtgagagtggagttattcccagagaggggagtgtgggttgaaatatcgctaataatatagaagggatagcatggctgtgtttcgtactctgcgaagaaaacacgtttgtatctaccacttctggccaaagtcgcaactattacatcttcgagatagcgaaagatactaaaaaactatccctcttcactacgtaataggggggatgaaataatagctttgatgtgacttggttttgctggtgcatttatcaacatcaagagttttgtgcatgagacagatatgtcgaagaagcaaaggtaaagtagttgaagttgtggacacacaataatgaaatatatattccatgcgaacgaaatcttctgtaaaatcccccgaaaatctgttgaaaattcctaaaaaatgttattattttgatgttttttcttgaaaaacgccacttacattttgtgagataaagcgttagaatagctatgctataagaatactttatacatatttaataatttattaacagaaagggagtatagatatggaatcgtattcatttttactgttcttggcgatcattatgatctcaaccaagattctgggtttatttacccgtaagattcatatgccggcggttgtcggtgcattagttgcaggtgtgatcttaggaccgtcctgtctgaacttgattacattgaccggagataccggcgtctttcttgagcagatggcagagctcggtgttatcctcctgatgtttaacgcaggactggagacggatctgtccgaacttaagaaaaatggtgtggcatctttcgtaacagcattgatcggtgtgattgttccgttgattggtggattcctggggtatgcatttttcttccacacagacttcagcgattacgatgaggtgttaaaggcagtgttcgtcggtgttgtactgacagcaacatctgtaagtatcacagttgagacgctgcgtgagatgggcaagctgaaaggaaaagtcggaacgacaatccttggcgcagctgttatcgatgatatcatcggtattatcgtactcacaatcgtaaccagcttaaaggataccagcgtaagcccgatcacagttgtgttaaagattgtactgtatttcgtatttattgcagtattgatcttcgtgcttacaaagttaaaggtatttgtggaagagcaggatgagaagagaagaaccgctatcatctgtgtagcgctctgcttcattctttcctatatctcagaggaatacttcggtattgcagatattaccggtgcttacttcgcaggactgatgctctgcacgatgaaagttggaccgtatgttgcaagaagatgcgagatcccgtcttacttgattttctcaccggtattctttgccagtgtaggtcttaaggtaacactcggcggaatggatgccagcatctggatcttcgcaatcattctgcttgttatcgccatcttaagcaaggttgtcggatgcggactgggtgcaaagatatgcggatgtaccggaaaggaagcgttccaggtcggtatcggtatgatttcccgaggtgaggttgcactgattgtggcgcagaagggatatgcaagcggtatgttagatgatgtcctgtttgctccgatcgttctcgttgttattgtaacgacgctgatcaccccgattctcttaaagcttgtcatgaaagacaatgattctgagaaagctgctgcataggggcatagaacagatattataaaatcaggatttaagaagccgtcacttttgtggcggtttcttttttcactctataggctatgtgagtttattgcttcttttgcaaaaaacagttaaaatagacacagaaaaaagaaatgaggagattgcaatgttacgggatctgcaggaaatatcagatggaaaaatatatggctgcaatgatatggttcgggcggcgtgcggagactgcgcgggatgtcatgcctgctgtgagaaaatggggacatccattgtgcttgatccctgtgatatatggcgtctgacgaccgtgaccgggaaaaattttgagcagctgctggtcgatacgatagagctgcaggtagtggacggcgtgattcttccgaacctgaggatggacggagaaaaagagcagtgtgtgttcttgaatgaacagggaagatgcaggatccacgcaatgcgtcccgggttgtgtcgtgtatttccgcttggcagaatctatgaggaaagcagaatccgctactttctgcagatggatgcctgtcagaagcccgggcgcagcaaagtgaaggttggaaaatggctcgatactccgcagatggaacgatacgaacggtttctgatggactggcatggcctgcggaagcagctggagaagcaggtgaaagacggaattggtgaacaggaggcaaagacgatcaacatgtttttgttaaatctgttttttataaaaccatatgaaccggagcaggacttctatgaacagtatgaggagagaagagcgatggccggtcaggcagggttaaaataaactgcggataatgtatggcaggagatggaagtatgataatcgacagaggattggatcagaaaggaacagatgcgaatattggaaccagccgcgtcaatctcacgcagcgttatgtggaatccgtcaaatacaatggtctgggggattttaccgaagaattgcgtgaggaagcagactaccggaagcgcattgaaaagattttctcggaaattcatatgactggggagacgtatgcggatctacagccagaggcattgatggaagcctactggcagggagaggaaatgatatcgcgttactactgggcaaagaggcgggacacggacgacattatctgggtgcgtgtggacgtgaggattgtaccgcagctggatacgggagatttgtttgccttttacaataactgggatgtcacgcatgagaaaaaccgtgaccgtatgatgcagctgatcattgagttcgactatgattatgtggaatacatctgtctgcagaatggtcatttcgagattatggcgcaggaaaaaagttccatgtgtccgagcgccagaggaacagactacgatgcggatatccgtgattatcttaccagagtcgcagtgacggatcagctggaagcacacatccgggcaatgcagacagaggaaatccgtcgtaaccttgaggcagagccactttacatacaggaaattgatgtgagagagtctgatggctcagtgcggcgtaaaatgatccgttatacctatatggataagcagatggggacggtattcaaaagctgtgtggacatcgaagacatcgtaacggaggagaagaagaagcaggaacgtctggagcgggcaattgaagaaacggagcgggcgaattgcgccaagagtgaattcctggcccatatgagtcatgacatccggacacctatgaatgcgattatcggcatgacatccgttgcaaggcaggaatgtcaggatgagacgatctgcggatatctggataaaatcaaatcctcaagtgagtttcttctcggactgatcaatgatatgctggatatttcacgtatagagagcggtaatctgaacctgaagtcggagcagatgagcagaaagacgtttggaacggcaatcaataccacgatcggcccgctgatggagcagaaaaacattacgttccagtgtgatctgcagcatatggaagaaatgatatacactgatgcggtgcggttcaagcagattttcttcaatctgctgtccaatgcagcaaaatacacgccagagggcggaaatgtgtggcttctgaccgaaaggctccgcacggaaggaaacgttgaatgggtgcgttttacggtgcgggatagtggaatcggtatgagtgaggaattcctggagcatgcgtttgaaccgttttcgcaggagggtaaccgcacgcttgccctgcaatggcagggaaccggtcttggacttgcgatcgtaaagaaactggtggtcatgatgcacggcacgattgaaattcacagtaaattaggagcgggtaccggggtaatcctcgatctgccgcttacgatctcgggcatcgatgctccggaaaaaatgccacaggcagtcatggcaaaacagaacctggaaggcagacgggtgcttctggcagaggacaatgagatcaatacttttgtggccagacgtattctggaatcaaggggaattattgtggaacatgcggaaaatggaaaaagagcggtggaaatggtggagcagaatccggagggatattttgacgcaatcgtgatggatatccggatgccggtgatgagcggactggaggcagccagacagatccgggcaatgagccggacggatgcacagactgtgcccataattgctatgacggccaatgcctatgaggaagatgtcagccagtcgttggcggccgggatgaacgctcatcttgcaaagccgatcgaaccgcaggtgattctggatacacttgcggggtatataggcagtaagaactagaaagttgcactgtaaatagaaaaagaaaggcatgcatttcgtcggaatgtcgatgtaaaagttgtgatactgttgctataataagttccgatgagaggagacggcaggatgaagcatttgaaacaatttttgattattttacttttttcatttcttggagaaggattaaaggcattgcttccacttccggtaccggcaagcatctatggactggtattgttgtttgcggcactggagcttggaataataaaactctctgcagtggaagatgcagggaaatttttgatagagatcatgccggtgatgtttattccggcgggggcggggctggtcgagtcctggagcgctttaaagccgatctgtgtgcaggtggttgtgatcatgtttgtatccacgattgtggttatggtgatttcgggaagagtgacacagtttgtaattcgcagaaacagaaaggcataaaacaatgaaggaatttttaaatcagtctgtatttttcggtgtggcaatcagcgtattgacctatgaactgggagtatttttgaaaaagaagctgaagtggccgatatgtaatccacttttaatttcgatcgtcgcggtgatcgtttttctggtcgcgtttgatattccttacgagagttataacgcgggagcaaaatatctgagctatcttctgacgccggcaacggtctgtctggcgatcccgctctacgagcaggtggagcttttgaaaaaacattccaaggcaatcgtgcttggattgatctccggtgtgattacgagtcttgtgtgtgtgcttgtactggcactgttgtttcattttgatcatgcgcagtatgtgacgcttctgccgaaatccatcacgaccgcgatcggcatgggaatatcggaggagcttggcggttatgtgaccatcacggttgctgtgattattattaccggagtgattggcaatatgctggcggagacggtctgccgtatatttaagattgaggagccggtggcaaagggaattgcaatcggagcgtcatcccatgcggttggtacagtcaaggcgatggagataggagagatcgaaggtgcgatgagcagtcttgccattgcggttgcgggacttctgacagttgtgctggcaccggtatttgcaggaattatgtagcacgcggtctgcctgccctatatgcagatcattatgcaccaggatcttatatctgacataagataaagagagaaaacaaagaagtggaatctttatgtattgtcagaatagaatggtacacaccgtgcaggagggggattcactgtatcgccttgcgagacagtaccacacaaccgtcacggaactgatactcggaaatccgggggtaaacccctacaacctgcaggtaggaatgaagctctatgtctgcccgggggaaagctacgtaccgccccagggaggcagcgcaaacaccgggaacacgggaaacagcggaagcaccgggaacaccggtaatgctggaaatggtggaaataccagtaatgccggcgtgggcggaaacatcggtatcggagtggtgattccgggtggacagcgcccgggcggaaatcagacagcgggagagaggcagaattcagtgaatcagctgtttgagacaatgcgtctggcgtggctggaactgatctactggacacggatgtatatgatgagtgtggattccggggcagatgcaaaagagcagtatgcagtggagggacgcctgttggaaactgcagatgcaatcacggatgtttttgcagagcggctgccggtagctgtcacaagacagctgcgcaatctgctcgtggaacatgtggagatgacggggcagatcatccgcacgttaaaatccggggataaggagaattatgaacagcagatccgggagtggtatgctaatgcgaatcagatcgcaacacttctcgctgaccagaatccctactttgcaggaaaagagacgaggaatcttctgttgaattatctggatatgacgcgcgagattatagaacatcagatgaacggtgagtatgaccagagcattgataccttccgggatttaagtgatctggtgctggaactcgctgattatctcgcaagaggacttctggcgcgctgatgtgctttgcaaacgggcggtgcctcttgtgcatcgcctttctggtactatttgcggcgctgctgatcctggcagtagtgcacagagtgcgggcgaagaaaaaagttcttgcattgactcccggggaacgggtgcggctgctcaatgaactggcggaaccctttggatttgcttatctgccgtcggaagatatttttacctcaaggctggatgcctggcagcgtgacaagggatatgaggcgaaatatgataccatgacggtgggtgccgggatggtgattgacgcatttcccgtgtactttaattatgagggaagaacctggctggtggaattctggaagggacagtacgggatcaacaccggcggagaggtcggaatttaccatgcgaagggcgtgattccgccgcacgcctatcacacggcgcattttgaagcggtatcggatgcagaactcccgagaatctgcagctgtctggatacggcagaggaaacgttttatgaaatctgtgccagacactggtggctcaccggctttcggatgggcgtgtatacaaaaccgtcgcgcctcagacttgccacgacgctgattttcccagagcaggagatggcgctggcgttctgggaaggtctccacaaaaccggaaaaccgcgcagcctttttcgcatctgcggaagagaagtcagtgtgcggatgaatttttcggaggaacacggattgattccgggaatctgcagaagcgtggtgcttctctggaacaggctgctgtgcagaggatttaggatcgtgacatacccgtggaaacggacggcggacagaatggtatttctatattatctgcttccgggatggtttcggaagattctggtgctttcgggcgggcgatgcaaaccgcgctgcaggaccaggaaaccgcacagatcatgtcggggcaggtgaaaacatgggatgttatcgaaggattgacagggcattggaacatgccctgcaccttccgcttggcacgggcagccgctatgtggtgatcagtgactgccacagaggggaagggacaacaaatgacaatttcctgaaaaacgcgtacctgtacgaggcggcgatggaacattatataaagagaggattcttctatctggaactgggggacggggaggaactctgggaaaaccgctgcatggaccggattgtgcactatcacgagaccgtgtatgagatgtttgcttgtctgcaaagccggaatgcgctgtgccgcatctatggaaaccacaatatggagctgagaaaaatcctgccggaggcgattatattagataattgcgagggcggaagggatgtctgcatgattcacgggcatcaggcggatttttttaattctgtgtgctggaggctctccagagctctggtgcgctacgtgtggaaaccgttggagcgctccggcgtgaatgatcccacgagtgcggcgcgcaattataaaaaggcggtccggtatgaacagtgcctggcgggctggaccagacttcacgaccgttatctgattgccggccattcacacagaccgagactgccggaaaacggggagctgtatctgaatgcgggaagctgtgtgcatcccgggtgcatcactgccatcgaactggaacagatgcagatgacgcttgtgaaatggaaggtggcgacgcgcccggacatgaccatgtatgtggtacgtgagaagcttgccggaccggttgccattttgtaggaaaaacgcgatttttcaaaaaaatcatttgacggaaccgccatttatgataatatatatatcgttatattaaatcgttaaagcgaggacggaagcgtccctgacgatagctggtaattggaggagcagaaaaatgattaaagttgtgaagtttggcggcagctctctggcaagtgcggaacagtttgcaaaagtggggaagatcattcaggcggataaggaaagacgttatgtagtgccgagtgccccgggaaaacgcaatgccaaggacaccaaggtcacagatatgttatatgcctgttatgcgctggtggaggcggaggaggatttccgcgtgccgctgatgaagatcaaggaccgctatgacacaattatcaatggactgaatctgaagctgtcactggaggaagaattcaaaaagatcagtgagaactttaaaaataaagcgggggttgactatgcggcgtcccgcggcgaatatctgaacggtattattatggcgaattaccttggctacgagtttgtggatgcggcagaggtgatttccttcgaggaggacggaacttttgacgcggagaagaccaacaaggtgctggcagagcgtctggagaaatgcgagcgtgcggtaattccgggattctacggggcactgccggacggaacgatcaagaccttttccagaggcggttccgacatcacgggatccatcgtggcgcgtgcggtacatgccacctgctatgagaactggacggatgtgtcgggctttctcattgcagatccgcgcatcattaaggatccgcagccgatcaagacgatcacataccgtgagctgcgcgagctttcctatatgggcgccagcgtgcttcatgaggacgcagtgttcccggtgagaaaagcaggaattccgatcaacatccgcaataccaacgcgccggatgacgagggaacctggatcgtggagagcacctgccatcagtcaaaatacaccattaccggtattgccggcaaaaaaggttttgtttccgtcaatattgataaggatatgatgaattccgaggttggattcgggagaaaagtattgtccgcgtttgaggagaataatatctcattcgagcatatgccgtctggcatcgacacgatgacaatcttcgttcaccagccggaattcgagggcaaggagcaggcagtgatctcagcaattcaccgtctggcaaagccggacagtatcgagctggagggtgatctggcgctgatcgcggttgtgggacgcggcatgaagtcgaccagaggaacggcaggccgtatcttctcggcactggcacatgcaaacatcaacgtcaagatgatcgatcagggatcttctgagcttaacattattatcggtgtgagcaatgcggattttgaaccggcaatccgtgcgatctatgacattttcgtggagacccagctttaagattaagatatgaagaacaacaagcacgagcaaaatgaattacagcgtatgatggaaggcagggctgcccgcatgattgcggctgcagtcactgtctttttgtgcgtactgacattgtttgaatttgttgcgctcaagatggagtggaatgtgcctgcactggcggtgctaagcggcgacaacggactgtggaccagggagtaccagcgggaagaactggtgatggacggcagcacggaaaacattctgctcgcagacgatggagagacaccgctcacaggaagtggtgagaatgccaaaacgaatgtgggggaaaacggaagcggcgggacggcgcagaccggtgaaaatgcagggaacggggaagacttgcaggtggaagggacagaagcggtgcggcaggaagagactgagacgccggatgtaagcggaaccggaaaagcggaagcggatgttaaggagacgcagacaccggaattttcgtattatatccgcatcaatcgcaagcagaactgcgtcacgatctacacccaggatgaggagggggagtatacggtaccctataaggcaatggtatgctcgaccggactttacaacgcaacgccgcgcggaacttaccagatttccaccaagtatctgtggcgggaactctatggcggtgtgtatgggcagtacgcgacgcggattcacgggggaatcctgttccattctgtgccctattacaagcgcgcaaaggatacactctgtacggacaagtataacaagctgggacagcaggcgtcgatgggctgcgtaagactgacggtggaggatgcaaaatggattgcggagaactgcccggaaggcactacggttgaaatatacgacggggaagacccggggccgctcgggaaaccggaggcacaaaaactggataaatcagatccggactgccactgggatccgactgatccggatgaggaaaatccctggcagcagacggagacgtccgtgacggagagcgagcaggaaaaacagataaaatagaaaaaataaaacgacgaaggcgacatcctattcatttgaatcgatgtcgccttctaaactatctcgtccatgggactgtacctctcttttctttttctttcggacttcttcgcttccttcgtaccttgtatcactcttcttatgacggtggatatcgcatcatatctgattaactcatctgatactgattcctctttccatgatttggattgtcacgtgtgtttttcgggagttagaaaaaaacgaatgcaattacgttttcggtggtctgtacctctctttccttaatatcgttttgggtaaatcgttacgtttctggtggcttgtaccttcctttccttcgatttcgttttcctttctttttgttgtctttattctatctgatatatgagaaaaagtcaagcataaaatgagaaaattataataaaaaatatttaaaaacaataaacaaagaataaacgaaaaaatattctgaaaatatagatgcaatagatataatatatatttttcgtaaaatacatgtaaatgcttcgctgtggcagaagagcgtgcgcttcatataataaagagaagggagcgtaattctatgaatagacagaccatacttctcatcagtgacatgcgccaggtttatctggcggagattatgaccaaaagaggactcaacgtacgctgcctggatatcagaaacagcgggacggtaaaagaacaaatcgagaagttgaaaagttttctggcggaggcggatatgctgatcctcccgattccggtgacaaagataccggaacagaaaatgctgaacgatatattgaataaaaacctgacgaacgatacgctggtgcttggaggctgcttctccacagaacagcaggagcttttggagcgccgggacattcactatctggattttatgaaagatgagattgtgacggaagaaaatgcagtggcgacggcggagggcgtgatcgcggagcttgtgaaccacagcccttataacattgaggaggcaaaaattatcgtcaccggttacggctgctgcggcagagcggtggctgcgaggctgaaagcgctcggcgcgcgcgtgacggtgctggcaagaagacgggaagtgcgcaaacttgccaagaaggatggattttatgccgcggattttgcgtttggaccggaggaagcgatgggggcggcaatgctggtcaacacggttcctgcgcctgtggttacaggtgcgatcatccgcgaactgccgcgggatgcatatattttagacatcgcgtccaaaccgggcggtacggattttgcctgcgccagagagtgcggcatccgtgcggatctggcacttggacttccgggaaaatatgcgccgaaggagagcgcctatattctggaccgggcggtggagagattcgtgcgaaaggagcatgaaatgtgatggatttttccaattataatatcgggcttggaattaccggttcgttttgtacgtttgcgaaagcaagaaaagaaatacagcggctgtgcgatatgggcgccaatgtggtgccggttttttcatttaatgcgcagacgtgtgacacgcggttcggaagtgcgaaagattatgtggacggaatctgcgagattaccggaaatgagggcatccgtaccatctgtgcggcggagccgatcggaccgaataattttctggacatcatggtcattgcgccctgcaccggaaatacggcggcaaaactctgcaacggaatcacggatacgccggtgctgatggcgaccaaagcgcatatgcgcaacggtaagccgcttgtgattgccatctcgacgaacgatgcgctcggcgccagctttaagaatatcggaatgctgatgaatatgaaaaatatttatttcgttccgttcgggcaggacaactgcaagagcaagccgaactccatgattgcaaaaatggagctcctgccggacacaatcgaggcggcgctcgccggcaaacagatccagccgattctgcagaccccgacgtaacgcagatctgacggagccgggcggagacagagacggaaaatgccggggacgttttattatgcaaaaaatcagagcatcttatgttccggccgcttctggcaggggcggattttgcgattagaaatgccgcctccgttacagccggaacattgagcgctcggtttctactcctgcaacttagtccacaaaaatcaatacgcctgtcccgggacaggcgcgttttgcgtttacaggtgtttccttacgcctgcttggatgcctcgtaggcttcgcgacaggccttagccagctgatcgccgcaggaagtcgggcgtccgttgcaggagatgccgccgattttctcctcaacctgctcgacggtaagaccctcgacgagcttcggaatcgcttgaagattgccgttgcagccgccggtgaactttacgttatgcacgatgttgccctctaattcaagatcaatctgtgtggagcaggtgcccttggtcttatatgtgtatgtcattttgaaatcctcctttattgaaaaaatagatcgttcagatcacttttgagtataacatggaaccggaagtgtgcaagaaaaatttgcagtaaagcggcagttaataaaaaatttacaattcttttacgcctgtttttattgtggtggtgctggaaaagtgttacaataacaatattgtgcggggtcatacccttttgcaggtgtcccgcaggagaatggattttgacacagttttgtgtaaaaacaggagtaggagctttttatgagtgcaataacgaagatcttcggaacccacagcgagcgtgagttaaagcggatttacccgcttgtcgacaaggtggaatcttaccgcgaggcgatgggagcactttccgatgaagaattaaagaacaagacgaaggaatataaggagagactggagaacggcgagacgctggatgatcttcttccggaggcatatgcgacggtgcgcgaggcggcgaagcgtgtgctcggcatggagcattaccgcgtgcagattatcggtggtatcattctccaccagggacgtatcgcagagatgaagaccggtgaaggtaagactctggtatcgacactgccggcatacttaaatgcgcttgagggcaagggcgtgtgcatcgtcacagtcaatgactatctggcaaagcgtgactctgagtggatgggacaggtccatgaattcctgggactgaaagtcggcgtggttttgaacgagatgacgaacgatgagcgccgggatgcctataactgtgacattacctacgtgacaaacaatgagcttggttttgattatctgcgtgacaacatggtaatctataaggagcagctggtgcagcgcggactgcattttgccatcatcgacgaggtcgactcggtattgatcgatgaggcgcgtacaccgctcatcatttccggacagagcggcaaatccaccagactgtatgaagcatgcgatattctggcgtgccagatgaagcgcggtgaggacatgccggagtattccaagatggatgccatcatgggcgtggagcaggaggagaccggagacttcatcgtaaacgagaaggataaggtggtcagcctgacacaggatggtgtgaagaaggttgagcagttcttcaagatagagaacctggctgatccggagaatctggagattcagcataacattattctggcgctgcgcgcacacaacctgatgttccgcgaccaggattacgtggtgaaggacgaccaggttatgatcgtcgatgagtttaccggacgtatcatgccgggacgccgttattcagacggacttcatcaggcgattgaggcgaaggagcatgtgaaggtcaagagagagagcaagactctggcaacgatcacattccagaacttctttaacaagtttgagaagaaagcaggtatgaccggtaccgcattgacggaggagaaggagttccgcgacatctacggcatggacgtcgtcgagatcccgaccaaccgcccgatcgcccgtatcgatcatcatgatgttgtatacaagacaaagaatgaaaaatacaaggcggttgtggaggaagtggtaaaatcccatgaaaagggacagccggtacttgtcggtaccatcaatatcgatacttccgagctgatcagcggcatgctgaagcgcgagggaattccgcatacggtattgaacgcaaagttccatgaaaaagaggctgagattgtagccggtgccggacagcatggagcggtgacgatcgcgaccaacatggcaggacgtggtaccgatattaagctggatgatgagtcgaaggctgcaggcggtttgaagatcatcggtacagagcgtcatgaatccagacgtattgataaccagctgcgcggtcgttccggacgtcagggagatccgggtgagtcccagttcttcatttctcttgaagacgatctgatgcgtctgttcggttctgagaagctgatggacattttcaatgcactcggtgttccggaaggtgagcagatccagcataagatgctgacatctgcgattgagaaagcgcagaagaagatcgagggcaacaacttcggtatcagaaagaatcttcttgagtatgatcaggttatgaacgatcagagagagattatctacaaggagcgccgccgcgtactggacggagagaacatgcgcgatgcgattttcaagatgatcacggatcgtgtggaaaattgtgtagatacctgtatttcttctgatattccgaaggaagagtgggatctgaatgaactgaaccagctgatcctctccatgattccgatgcaggcagtgacgccggaggacgtggacagcgttaagaataataaggaactgaagcatctgttaaaggagcgtgcagtgaagctgtatgaggcgaaggagacggagttccctgagccggagcagttccgtgaacttgaacgtgtcgttctcctgaaggtgatcgaccgcaagtggatggatcacattgatgatatggatcagcttcgtcagggtatcggactgcagtcctacggacagagagatccgcttgtcgagtacaagatggcaggatttgacatgttcgacgagatgacggcgagcattcaggaggatacgatccggctactgtatcatgtgaagattgagcagaaggttgagcgtgagcaggtagcgaaagtgaccggaacgaacaaggatgagtctgcgacgaacacgccgaagaagcgtgctgcggcaaaggtatatccgaacgatccgtgtccgtgtggaagcggcaagaagtataagcagtgctgcggcagaaacgcagcgcagtaggagtgctgcaaacggcagactgcaatgacgggcggacggcagaacgctgtttatccggcagaaaagtcgacagaacagcataaggaagagagagcatttcaggtagataattattgccgggaatgctctttttgcatattttcatctgtatgcagaaaaatacatacagagtgcatttttgggtggcaatttccagaaatctgatttataattcataccaaacaggtagaatatgagacggcagactgccggacagaaggaggaacactatgtacaacgtaagaaaagtgactgaggatattgtttgggttggagccagtgacagaagactggcgctgtttgaaaatatatttccaattccgcgcggggtatcctacaactcttatgtattattggatgagaagacggtacttttggatacagtcgatgcgtccgtggcgggacagttttttgaaaatctggagcatgtgctcgacggacggaaactggattatctgattgtcaatcacatggaaccggatcactgtgcgatgatcggggatctggtgcgccgttacccggaagtgcaggtggtcggaaacaccaagacatttggaatgataaaacagttcttcggaacggatttcgcggagagagccgtgacggtaaaagagggagatacgcttgcaaccggtgcgcatacattgcactttgtgatggcgccgatggtacactggccggaggtaatggtaacctatgatgagaaggacaaggtgctttttgctgcggacggattcggaacgtttggcgcattgaacggcaatatttttgcggatgaagtcgattttgaccgcgactggctggatgatgccagaagatattacacgaatatcgtcggaaagtatggtgcatcggtgcaggcattgttaaagaaagcctccgggctggagatcgcagtgatctgcccgctccacggacccatctggcgggagaatctgggctatattctggaaaaatatcagaagtggagcacctatgaggcggaggatcaggcggttgtgattctgtatgcaacgatgtacggtaacacggcatcggcggcggatgcgcttgcaggaagacttgcggcaaagggcgtgaagaagattgccgtttatgatgtctcgaacacccatgtgtcggagctcatcagtgagatcttccgcgcaagccatgtggtgtttgcagcgccgacttacaacggaggcatctatccggtgatggagaacctgctcgccgacatgaaggcacttgcggttcagaacaagaccgtagcactgatggagaacggcacctgggcaccgacgacggcaaagcagatgagagaaaaactggcggaactgaaaaatgtgacgattctggatacgcagatcaccataaaatcggcgatggcaccggagcaggaaggacagcttgaggcacttgcggatgcgatcgtagcgagcatggataagcagtaattgtgttactgactttatcattgcgttttgtgggaagcaaagactttctcatataaataacggataacaaaagaagaaatagcgcgatcgtttcaggatcgctggttgggaaaaggcacctgtttgcgtgtacaaagtaatatgtacgaagtggatgggtgtctttttctgctttataagaaaatgcattctgtggagagaactctttttataacaaaagcgaacatttgtttgcaattgaaaaaagatgtgatataatgtgcatatgcaatgagcagtgccagacgtgacggctgcgatatatgtctgcttgcaggctatatatcgcagatgttgcggatgatagggcgaatgcccgtcagtccggaaaatctatgatttttcggacgagcactgcgggtatgaacagagacggttgcgcatgcttgcatgcggcagacggatatgcgccatgtgaacgcgcctcgcccggacttttgccggagcgtaatatgaacgtgatatttttgaggggcttatcactgggatagaggaactttgaaatgtggacaatacaacgaatggacgaaatggatgatggagatgaggaacgcttgccgggcgagccgatgatgacagcggttacgttggaaagtgatctgggagaaatacttcaatttcaaatgcctcacaactggttgcttatgcagggattacaagaaggagaagagtggcctgaggacatcgaggaggaggattcagaagcgttaaaagcgcgggaacaggcagcgtggatggaaaattattatcatgcgttgcaggaacttgagggggaagaagagcaatgtaagcatggggcagagggataaatcggaatttgtggagagatttcttgaactttccttattttacgggctttccagccccttaaatagtgaaatgatatgtattttcccttatttttgaccttatgcggaatcagcaagggaaataagggaattttttatttagtcgttgcctgccactttatcaagaagtctggcggagttccgctttgcctttcttgtagagtgggcgtagacattcattgtggtactgacatcagagtgccctaacagttcctgcacatcttttggggcagctccgtttgagaggaggttgcttgtgtaggtgtgtcgcaactggtggaaatggaaattctcaaatccgtccagcctttttgcaactgatcggcaggcaatgctgagtgtgcttggcagttccagacatccgtccggtctcaggcagacaaaggagatttccttgtaatctaccgggatttcttcggttccgtccagatgataatattcataatacactctgtttttgtcctgtgcttccttgtagaaattgcggtggtaaagttcaccatactgcatccggcttttaagctgtttttttctggcggttttcagtatttcagtcagagtatcgccaaaatcaacaatccttactttctttcgcttggtcggtccgatgatgtttttatgttttgtgccatcatagcggatacttcttttaatggtcaggcattgttcttcaagattgatgtcctgccatgtcaatccgcaaacttcaccgatacgaagtcccgcatagtatgcgatctggattggcaggattgcaggtggattctttactttgaggtattctatcagtctctcataatcttcatgggaaataggctgtatgccttcttctacctcatcatctgagaataaatccacatcctctgcctgttttttcagcttaatatactgcataggattaaaagtaatcaactgttttggaaatactgcaaaccggaaagcctgttgtaatactgctgaaaaggaatggatgtaatctttactgtatccttttctcacttttccatctggaaattccccaccgaatgtaagcagatcgagaaatgcctgtaaatgttcagcagtaacggtttttaatttgcgttctgcaatcggatgtttcttgatacaacggattgcaccaagataattttccactgtaccattgctgagtgttccgactttcagttcttcttccgcccacatatcaagaagttctcctacagtaagattatctgtctttgcgacaaatttcttgctttcgtaatcatccattgcctgacggagcagtttttccgtttcacttttactttctgttccagcgtattctttctgaaccagattgccgcttgcatcttctacatagaagcggtagtaccatttctttcctttttttcttacagatccttttgccataatcgtgtgtctcctttcgatatcagacaatcggaactgatgaaatgcttcttgcgtgtaagtatatcataactccggttgtcgttctataccgaatcggaatcctcatacaaaacttctgataaaagattttcaagcctttgttctgccatttccggtttcttggaataaagccttacgatatctgccatgtcgttaaaggcattaacagtgtgggtgatctcccggagaaacataatctcgttatattcatcattcgattcaaaccccattacttttgcaatatcagcttcattcgtgttgcccttgtaattcttgcaggcaaactggaatgattccagaaacaggttatattgctttaacatcaacagcagtaaatctttggaaaaagcatcttcctttttactaaggtcgagaggtaactgtttgagaatatcgcccattgcatcacgaatctgtaattctttcttatccgtaatatcggtttcgtattcatcggtttcccctctgagccattcaatagatacatgaagtgcttccgaaagaccttccagcaccatctttttggtattgtcaatcgaaccattctcataacgcaggattgtggaagcggtaactcccatcttctctgcaacataaggctgtgtcagatttaattccagacgacgctgttttgccctgctgcctatcagcttgcgtagttctttatctttcatgctgattgcctcctttttcggtatgtatgaattatagcatgtacctcacataattgcaatatgcaatataataattatttttaaaatttcataacgcttgacaacacaatataaaaccgctatactaacagcacaacaaaaattgcataatgcaattcataaggaggtgacaagatgacggaaagaaagattgcattatccatcgaggaagcagccgactatacaggaattggcagaaacactttgagaaagctggttgaatggaagaaacttccggtattaaaagtcggaagaaaagtccttattaaaactgacattctggaaaagttcatggaagccaacgaggggcgagatctgagggataaaggaaatgtaaaaactgtcacaagaaatgtggcaacttaaaaaggcggcttcctacgaaaccgccaaaggttctatcagaccgaagccatgatatacctacacgcaagaggattataccatgtgcttctcctgatatgcaaccgggaactaatgtttatcttgtcggaaaaacatcgacaagataatgctccgcaaggatgcaccacgattctgattggaattatgtcaacagagctgaccagaatcgtgtgccaaatcttagcagagcaagatttgattataagagaaaggatgaagacgatatggcgaaatcaacaaagacttatgaagaaagaatacgtgcattagagaaaaaggaacaggaaagcatcgaagctaccaaaaagctcattgcacagcgaaaggaactggaaaagagaaagaaagccgaggaaagtaaaaaacgaacccacaggctctgtcagattggcggtgcggtggaatcggttcttggctgtccgattgaggaggaagatttaccaaagttgataggcttcttaaaaaggcaggaaacaaacggaaagtttttctcaaaggcgatgcagaaagagccacttacagatatggaggaagtgtaatggcggagggagtggtttttccattcccttcattgcctttgaatgaagggcgcacttatggacaaccagaggtcgtccttataagtttgccacaagtggcaaccggtctgcgcttacgcttgccgggctcgttccgtcggcggggctttcagccagacctgctcatgccgcagggggcactcttgcgcagagggcgttccgacagcttcacttctgccaaaccagaagaagatgctgtcggaaatcaatgccggatacggcagaaagggggaatcgtatcatggcgatatttcactttacagtaaagattgtcgggcgcagtaaaggaaaatctgtcatatccgcatcggcatatcttaatggagatgtgatgaagaatgaggaaacaggcagaatcagttactatacttccaaaaaggaagtcgtctacaccagtctgatgatgtgcgaaaatgcacctcctgaatggctgcatgtaccggaagaaaatataaaaaggtttcaacagtctatccgttataaaagagcggatgataaagatgccgcactggaaaagtttaaaatcacatttcagaaacagcgtctatggaatgaggtattgaagatagaaaaaaatgcagatgcacagcttggacgctcatttgaattttccctgccgaaagaatggagcagacaggaacagattgattatacaaccgaatatattcaaaagactttcgtggacgagggaatgtgtgccgactggagcatacacgataagggcgacgggaacccacatgtgcatttacttgtaaccatgcgaccattcaatccagaccactcatggggcagcaaggaagtcaaggactgggattttgtcagagatactgacggaaatatcgtggttgatgaatcccacccggactggtggcaggataagaaaaatccagaccgtcatggaatccgtattccggtacttgatgaaaacggagtacagaaagtcggggcaagaaacagaaaacaatggaaaagggttctgactgacgctaccggctggaacaatccaaagaattgtgagttatggcgaagcgaatgggcaaagatgtgtaaccggcatttatccatagacaatctgattgaccaccgctcttatgaaagacagggcaaattgaaagtccctacgattcatgagggtgcagatgcaaggaagattgaggaaaaatatctcaccgggcagataaggaaaggttcatggaaggtcgaggaaaaccagatgataaaaaaacaaaatgcactgctgcaaaaggtaattgcaacctttggtaaggtatccggtgcattgtcgatgtggagggagtggttgaatgacattagaagaaagcaaagaagtaattcccatgatggaagcaatgattacacagatagaggaacagtagaatatcatggcagagatgcttcaggagatacaggaaaaggacgagaagctgatgtgctttcaggagcaggaagaacgattgcagcaattagagaaagaattgtcagagctgctacaaatcttaccggatacagaagaactgttgatgcttctggaagaaaagacagaccagatacagaaactcacagacgaaaatcagcaatggcaggaattggcacagaaattaaacagcgagaaccggctattgcagaaacagaacagcgaattactgaacttgaacagcaattagagaaaggaaggttgattgatgaacgaattaagaaactcaaagagcgacgatcaactggaagagttgcttctgctgacagagcagatgcaggaagaactcgaccagaaagaccggactatcagggaactgaaagtgcagctcgacgaatcgctgaccttgaacgagaagttaaacagcgagaacaaaacagagaacattcaagccttaaagaacgacttgaggaaaacaaaagaattgttgcagagcgagaaagagaaaacacacaccgtccaagccatgatagaggaatgtcgagataagcagagacaggcagaacaggaacgggattatgcactctcccatcagaaaaaagtagagataccggttgaaaagccggtactctatcaaaagtgcgggaattgtaaacagacagcttatctgaaagctaaggaaaagtatgatatgcagagggaaaaactggcaggcagatataaaacaaaaacagccatgtatgaagcattgatgtttctgctgatatggtattccgtatcaactactctttttcagatgatacggtcaaaaatatttatttctgattgcgtggtattctttgatacaatcgcaactttcacacagaccattgctggctgggttgtactggcaggaaagaacgtggcacagattagtgatggaatatccaatcctgtcgttgctggaattataaactggctgataagaatattgatttgcggtggatgtctggtgggtgtgggaatacttttggcattcatcgaaataaagattgcagggctatataagaaatactgttgggatatgattaccataatggtgatacttgtaagtatggcaatagctatctactttggggattggataaaggaagtattgccaatcaatctgctatttctcttattattcgtgcaactggtatatgttggaatcaggtggtatgtaaagggatggcgggaaaacagaggttatgtttaaaaataaaaaaattgtctgagacgcagcgaagtaaataaaatgagtagtattataagaagtcagcagtgcgtgaataaactgctggcttcttttttgatagatacagtcactctcagagagtgtgcaggatagtaaagtaataatatcaacatgccgatatagaaaatgcagggaagcattgtatttcaaagagtttgagatacagagcttctactaaggcagtggtcatcttgtaaaaatatggtctttgtgtgcgtaatatggtcgtttgatgatatgggactaggagaacaggttattttatccgataaagaaagcaaaggaggttactatgagtaatacaattaatgtgaactatatgacacgggcttacaatcagtaccagcagaaaaatgcggctaaagatcaggagaaggaagatacaaggtttgcggatagtgtaagagaaaagagcgaagctagtggaagtatagtgggcaattcaaaaataggttctgtgtctgctaaagatatgacgatggtggaatacaagcagtacatttacaattcagataaaatgattggaggaacagaagtatgcacattggttctggtctaaatacggtatcttcaatgtaccgccaacaaaaaggcaataatatgaaaacgcctgcatctggggaaaagacattttatacggcagaaacaccgaaggtatatcagatattcacaacagataatatgttgtggacaggaggtaatggcaccggtctttcttattgtcttaaatatgcggatgattcaacggatgaaaatccggtggtgttagcgaaaggtgtggatgaaaatggaaaagagtttgaacaaagaatatatatcaatgacgttaatccatcaagtgctacagtagtcgaaatgcgtgcattggaggcacattacaaagtggagaagcagggaggtttcacatctttgccgcttgaagctggtaatatgggacttaacgacagaagagattttatctcaatgttcaaaaaaagcatagaagatttaaacaaattgggaaggtttgacttatcgttgctttggacgaaaagtatggatacatatcttaatttgccaaatgcaaatagtaagtataaatagtgcttagtcatttgaacatagggaaaaaagagaacttggattacatatcatattgaggctgagagaaattaaatatccaagtcgttcaatataatagaaattattttaagtttcaataacagggaggtaggattatggcaattacgggtatcaataacagcagttacacatcgtattatgcttcaaattataagaatactgtaaaaaaaacagatagtgaaaaggatagtacaaatacaaaagacggcaacgtgacaacaagtacagttgaattaaaaacatcacgtcccggtgtgacaaaaacagagcagattaagacggggtatagcaatgtaaatgattattcaaaatacttgcaaggaaaataccattatatgaatacgggaacgacttcaatgcaaggggttccgacaacagtatccgtttcaagtgcatttttacagaagtgtatgaatgatccagaaaaagcaaagtatctggaggaaaacttagcagccattccagattgtgcaaaaagtgcggtgaatggatgtttgggcactttgacaaatctgagttatatgattgatgcaaacggaaatatttcggtggcaatatctggtacaaatgatccagatgggaaaatagcgaaagagaatgctgaacgaaaagcaaaagagaacagagaaaaagaggaaaaagtaaaagagaaaagagctgctaaaaaagcagaggaagaaaaagctgcaaagcaacgtgcagaaaaatcggcagaaagaaaagaaacgggtgattataccttatccataactggtaatgatgtaaaaagtatgacacagagccttgtagcagaatctgtgagtatttctgcacctgatagatcaagttttgatattaaggcataagaggattcgataaaaggaaaatatcaaattggtgcattggatggcatcaccagagagtagagtggcagaaagtcagtagatataaatcgttttattggttcattgagcaatgacagtgatgtagattacctgaaaatagatgcaggttctttgacatcgagcaagatagataaagaagtatagaaagtgtggactaacttaaggaggttgctatgaaagttcaaggaaataggtatattaataatccagagatgataaaaaataaggttgagaagaaaacaactgttcctcagaatattatttcggaggatgatgtgaaaatcagtgattcagcaagaaagttagttgagactgctcgtaataaggtatcggattttcatacaatgcatttttcgtcaatcaatggagagataaaagaaataccagcagaatataaatgtgaaaatttattcaaattagatttgaaagcaacttccatttctggagaacaaaatgcgtttgaaggctgttcggaaaatcaatcagaggtttttgaaaaatggctggacgaaaatgcttctgaatatttgacagaagatgaaatgaaagatttaaaagagaagattaatgcaatgacagcagatgtagattctttgaatgctcaggagggatatagaggaacttcctatgaatctgtatttttgttaagtgcaagtgaagcggggctaagaaaagtaaatgaaatgtatgttccagatcaattacaagcaggtttttcagacatgattgacgaatatgttcattttaatgattcggcacgtaattctatcatggagaaaatgacaccagattacatggttgttggaattggaagcaaaacagaatcttataagtacaagtcagaaataatctcagatgagacagctttttatacaaatgagaagaaagagataagtggtatctgcaatcagtttttaaatggtaaaacagatcaaaaattattttgtaatgagatgaaagaccgtttaaatgattactatggaagcaggtatgaattaaggaatcagccagaagctgttgaaggcagagtaaataatatgctggacaaattgcagcatatgtttggcgtttaatgttgaaaaagggtttggagaataattatgaagacagtgacagatgtaaacacagtaaaccagctattgacatattcaaagcaggcaggggcaggaatacaccaaaaagcaatacagatgttgcttggagcaggaaataataaaaaacaggacagtttaagtatttctgatgctgcacgaggcttttcaaagcaatccatagctgcactgatagataaaaatgcgaatatttctaacagtgaattagcttattattttgcaaactataataattcaagtgctattttggatgcaatcaattttggggagaatgtttcctgtggatataattctgattttaaggagtacggggttatttcctttgaccttaatgggagcagacaggtagtacctaattatgcagtaccgaaaatgaatacaagcaccatgtcaggcatttgtgctgcgaataattctctggtactaagtaataaaagttattatgcatggacaacatcaagtggcagtaaatatacatggacggtcaataatggaaggataggctgggcagcctcggaatcgttgcttgcagagaatacaaatcaaaaaggaacaaattataagtgggaaatgtgtaaggcaggcaatatcctgtctgatctggcacagggaaagagtgtgtgggggtatctctacagcaatgaggaggtattgtccgtctgtgagaaagtcgggatttctccgggattcttttctatagatgcgggagcaggaaaacacacttatttattgcaggaatcaggaaagaccataaatgttgacgcaaagataaaacagttaaatgatataaactggatagaaatcggatataaagaaggagatacgtttttcgtttatggtaaagagtatgctattgacagcagtgggcatatcaatgtttcggcagaagatgaatttacatcaacggaaattaaatatccaagtcgttcaatataatagaaattattttaagtttcaataacagggaggtaggattatggcaattacaggtatcaataacagcagttacacatcgtattatgcatcaggttacaagaacacggttaaaaaggcagcttgtgatattcaaaaaacaaaggaaaattcacaggtgagcaaaacagaagagagtcaggaagattatgtaaaaaaattgcaggaaaaaaatcctcaaatagatattgtggcaggaagttcggataaaaatgtaaaaacagctaatcgtacaggaaaaacagatgtgaggattgctcctgagattttaaataggatgatgagtaatccagaggttgccacaaaatatgaaaatatgttgtcaaaaattccagcattagatagatgggctgactcaatgattaaatcaatgactggtagtgaagttaagtatcgtcaggtatggatagataaggatggtaatatgggctccatggttattacaggaccaagcgaagaacaaaaaaaggctgatgaagatagaaaaatcgagaaaaagaaagaaaatgaacaaaaacttgcagaacggagagctgaaagaaaagagaagatgaagaaaattcaggaagatagacgcacaatatttgcaattggtacggatatgaaaagcattacagagaatgttgtagcacaggcagtaggtacagctccatctatcggaggaagttgtgatgttaaggcataaaaggattcggtaaaagggaaatatcaaattggtgcattggttggaactgcgattttggctaaaagattgtgaattgccaatataatcaatagtttcttctatgaaaagataagatgacagggtggaaggctatggagagctgaccgccctgtttttatccagaaaaatgcagaaataatcaagagaaaatcaaaatctttctgctattctgtttcatgggttttatatgtacgaagataggcttctacaagtgcaagaatggtggttatctgatcgcttgtacattctgaaggataaaccaacagtctttggtaatccagattatcaaatgaatagcagttctgtacagaaacaattaaaagcagcagggatcgacacaaacagtaaaaagtataaagcagtactgagtgagatgatgaaaaatggaaacggtgcaatgtttacaaatgttcaggcaattaagaacctgatgagccagtatgacaaaaatggagactggattgatccgaataccggattaacaggacttgctgtaacggatgagaacagaaacagttataaacatatcatttgaggcggtttttaatgcgaaagcctaatgaaagaatggaggtattataaaatgtctagtgtgaacaattatatgaatggcatctatgacaataacatatcctgtaggagttgcatgttctgcgattatgtattttataataaagcaaaatggtaattttttgaaaaaagtttcggattagatgtagtgtttgccgctgaaaccgtagtatatgagtgaagccggaaaggaggcggtgtgatgatagacgatgaaaaaatcatagaaatgttttttgagcgttcggaacagggcatacgggaactggacataaaatatggaaaagcctgtcacaatctttcctaccatatagtagggagcagacaggacgcggaggaatgtgtaaacgacgcttatttaggtgcatggaacgccattcccccagcacgacctaacccattgttgtcgtatcttttgaaaatcgttcggaatatttcgctcaaaatctattggagaaaggaagcagccaaacgaagcagtcattacacgattgctttggaggaaattgaagcctgtattgcagaccagaaaaacattgaagaagaaatcgaggtcagagagttagcctgtatcattgagtcttttttagacacgctgactatcgaaaaccgcgttatctttatgcgccgctattggttttccgacagctacaaggacatagccgagtttgtagggctttcagaaaaaaatatttctgtccggctgacccgtatccgcgagaaaatgaagcaatacttgattgaaagagaggtattcgtatgaacgcaaagaaattttctgacgctatgagcgagcttgatacaaaatatgttgatgaagcactcaactacaaaacgaaaatgaaaaagcctatatggataaagtggggaattatggcagcctgtctttgccttataatttgcgtagttacaattccgcgtttacttaatggctctaatccccctatttctggagatttggctcctatggtttatgtaaataacaagttgtatcaatatacggatagtcaactcgattttacagataaagaaagccagttcacttatttaggggaaatcgaaagcaaagttagctcatcgcaagagccaaaagagaatttccaagccaatgacgatattgtaggtgctaaagtatatcaatatgaaaataatattgtggttttaattgatggtaaatatttcttatatagtcatatggaagatgctgaaaatgaaacggttgaatttgaaggacagttatttaacaaatcggacttatccgaagaaacccttgaatggcttgagtggtataattcgataccgccagaaaaacaacttgctgtcaattcaattccagccgagctatatactgatgacggtgctggaacggttgacgcagaccaagaaaaataattttgattgacacccacaagggacagccgagattgaggatggaaagaagaaaatccgccagtttgagaacttggaaaagaggttgcgtcaaaagttatccaaagaggaacgaagaacacgcaacaaccacctgtataatcaagagggcacttaacagtgaaacttatttcttggagatttatgacgatatatactatatagcattgagttaattctaaacggattttgaatttatttacaaggaggttttatatgtcaatgaatatcagcggattaggcaatacctataatggtattaacacaaatagtaaacaatataaggctttgaaagaaaaaggccggttatctggtattatgcaaaatgaagccatgatgtcagcagaagaaagattgatatatgaaacattcggtggaagagataccattattaagaatctgatgaagcaatttgattcggatggcgatttactgaatgcaaatggagtggcgggaatggatgttaccggaaaaggtacatcatggcagcagctcacgagtgtatccgaggaatatcgtcaaaagatgtttgataatgtgaagagggaatttattaaggaaaacggtatttcaaatggtgatacaactaagcgttcagatatttttaaggattatcagttaagcgtaagtaaagacaaacgtttaagtggtacatggactttagagcaatacgaaggacagtatagagctgctatgtatgcagcagtgaaatcagctaatccaaattggaaaccgggacaaaagtttgatacaagcattcttgataatgtcaaaagagaatcagtggaatctactcttgtcaaaaatggtaataggttagttcgcaattctattgatgtatcagtatagaatacaacatctttggtgctagagatacggtcaaataagctgctccatcatgggaaaagtataaaattaggagctttagataatatcacaagggaaaagttttcaaaaacttctggtaactctttgaaatacatatcatatcaatagatacgataatataaattatgtttgtatttgttgataacaggtttatatcggaaaaattgtaaatttattttctatgtgaattttcatttttgtagggctggcattagaccagcccttgatttcattataatagataaaaagatattgaatatatatgcacggtaaaaagacgattctcaataaatgagattgggaaaaagtaaccttagtgctgttgaaaaaatcaccatagttctaatgaatcttctgcatctacccatatctgcattgttccatcaagatataattttgcatattcaagcggtttatcaatggcaagtgcgttcaatgcacagtctgatccgggtgtggtttttaaatccttttcggcttcccaacagtcaatgcggagcatataaccagcagaagtataaatatcaatgctgtttctgtgtggattgtattctgcaaatattgttctcatcgtatagaatctccttatcattcaatcagtcatttgttacaaaaatcagaagcatttcaatcagttcaccatgtcacttttattttgtgttatactgttttatagatttttcttgcccttgtatttgcccttatcagagttcgtaaacactgacgggacgatataacacaagggaaacaataagggaaagctcacctgcgataaatccagtgttttcaagggcttgcagagaatttaataacaaaatataacagttattaaattccctaaaacaggtgaaatctcaatcggaatttgacgaaggaggttgattgtatgaaaaagttgatagcattagttttagcagtggtttgtgtgcttggcttggttgggtgcaacaacaagacagtcaatattgatttaccttttgaggtaggtgatgttgaaaatatagaaatgtatcactttgttggagcacctgtgtcagcagaaaagaaggtcattgttgccgaagaaaccataaagaacttgtatgatatgtttgaggggctatccctggaactcaaagaagtagaggaaaccgctggagcagagataaccagtttcagatttaacctttctgatggaacaagttatgaactgatttatggctgcgatggagtaaagacaggcaatctgaaatcttccacagataattttgaatactttacaagtgcagatattagctcttattggagcaacactgacttagaggcagttcccgttgaagaaagcgagttgccaaactaagcagaacaattcctgtttttgaaattgagaaatcggaatttggaggtacacgatgataataaaaattgttacaatttcactgatggcagtgttctacatctgctattttgcaaagctgattagtcagaaaaagcaaggcataaagacaggccaattaggaaaaggaaaagagggatttgtcaaatttatagaagtagctcttaaaataatcacatatttgcttcctgtaatacagattatcagtattgtcttttattcagaaacagcacatattgtgttgcaatttacaggagttgtaataacaatgttcggtgtacttgcttttattgtttctgttacacagatgaaggagaattggagagcaggtgtgcaaaaagaagaaaagaccaatttggtaacaacgggcatctattctattagcagaaatcctgcatttttgggttttgatttaatgtatataggaatattgttttcgttctttaattggttcctttgctttgccacaggttttgcagtggtattttttcatttacagatagtcaatgtagaggaagattttttgatagaagcatttggaaatgagtacctgcaatacaaatcaaaagtatgccgatatttaggaagaaaaagataacttctagtttttgaaatcgagaaatcgatatttgtggaggtcgaagtatgggattatttgataaattaaaaccgaataaaaacaacaaagatttctttgaatggttagatttgatcttaaagaatgaattgaatagtgaaataaaagcgattaactttaatttatatgaagatacagataataaatggtctattgaattagtcggcacattttcattcgatagggataatgacgattgggcttgtgatgaagtatttgctacaagagataatccttttatgatagagcgtgaaagtgattggaaatcaatggaaacattttttattggtttattgaatgaatacctttcttttgggaaatatgctggaagtttaaaaaaatatcaagcaataggtattggatttgttgatggagatttacatattttatatgaaagataatgtctgcttgttagcaataaaaatcggtattttggagatgcgtttaaatgatttctagagcagaatatattcaacaaccatattcaggggaatatattgaaaaaatttatgatataaaaagtccatggaattcaactgattggacatggataaaatttaccgaagaagacgatatttggtgtggtgaatttagaggtaaatatagaggggtatcttgttctacaacattaggaattattgttgttttgacttctgattatatgtatgtgctagatatttatggtggtgaaattatggaatattattcacaaccagaatatgtagatataacagtcacaccatttggaaaaattttagttacagacggctatggcattgagatgtttgcaaatactaagattagcgatatggaaaacatagttcttcccattaatgctgataatttgaaatttgttgaatggagagagaatattttaaaaatcagttgttttgaatttttgacatggggaaaagaaatagaactatatttgaattttgaaactatggaatggttgataaacaaatagcgcatgaaattcaagtttgcagaatcggaaaaatcatgattgttaggggctgttggaacgagagatagactgaaaaatcaggccatattttcttgcttttgagggcggttcgagacttgagataatgaataagccggatatggaggatatgaagaaaacacttaaccgaacaggtctaatccatattgctttcagcgtcggcagtaaagaaaaagtggatgaattgacaatgaaactggaagaagcaggatatccggtcgtcagtggtccacgcacaacaggcgatggctattatgaaagctgtgttgttgcaatagaggaaaatcagattgaaataacggtataactttccacttgcagaatttcattgattgagaagtatgattttgttgtcaaggatgttaaaatggatggcaaggttcagcttattaagctgcaaaaaagtgaaaatttttgatttgcagaactatttcaggggaggaatgtggtatggaagattttagtataaacgaaatgcagaaaatgcagagaagcttgcaggataagtacaaggacagatgggaaccgatctgtccggaaacaggacagaacaagatgctttggatggttggcgaaataggtgaagtgattgatattgtcaaaaagcatggtgcagtgaatgccctgacacaggaagaattgagaaaagatctggttgaggaaatggctgatgttcttatgtactacaatgatgtcatgctctgttacggaattacggcagatgaattgaagcaggcatataccgggaagtttgagaagaacatgaagcgttggtaatttccgatttgcagcatcaaagattttccggacatgtactgcacagccgggaaagggcgctttctattttttatgagaacataaaaggagatttgcaagtggatcattttaaattacattccaaatacaagccgactggagaccagccgcaggcgattgaagaactggtgcgcggattccgcgagggcaaccagtttgagacgctgctcggcgtgacgggttcgggcaagacatttacgatggcgaatgtcatcgaacagctgaaccggccgacactgattatttctcacaataaaacactggcggcgcagctctacggggagatgaaggaatttttcccggagaatgcagtcgagtattttgtgtcatactatgattattatcagccggaggcgtatgtgccgcagacggatacctatatcgcaaaagactcggcaatcaatgaggagatagataaactgcgcctgtctgccacggctgcgcttgtggagcggagagatgtgatcgttgtggcatcggtttcctgtatctatggtctgggcagcccggaggattaccttggcatgatggtatcgctgcgcccgggcatggagaaggacagggacgaggtcatccgtgcgctgatcgatattcagtacacgcgaaatgagatggattttcatcgcggcacgttccgggtccgcggggatgtgcttgagatattcccggcaaactatggcgatacggcgatccgcgtggagtttttcggggatgagattgaccgtataacggagattgatgtgctgaccggcgagattaagtgccggctcgagcattttgcggtatttccggcttcccactacgttgtgccgcaggaaaagattttaagagcgtgcgataacatcgaggcggagctggaagagcgcgtgaagtatttcaagggagaggacaagctgctggaggcacagagaatcgcggagcgcacgaattttgacattgagatgttaaaagagacgggattctgcagcggtatagagaactactccaggcatctggcggggcttccggcgggggcgacgccgcacacactgatggattactttaaggatgattatctgattatcgtggatgagtcccatatcacaattccgcagatccgcggaatgtatgcgggggatcagtcacgaaagagcacgctggtggattacgggttccggctgccgtctgcgaaggataaccgcccgctgaattttgaggaatttgagggcaagatcgaccagatgctgttcgtttcggcgacgccgaacgtatacgaggatgagcatgaacttttgcgcgcggagcagattatccggccgacgggactgctcgatccggaggttgtggtgcgcccggtagaggggcagattgatgatctggtgggtgaggtcaacaaggagatcaagaaccaccacaaggtgctgattacgaccctgacgaaaaaaatggcggaggatctgaccgattacatgcgggaactggggatccgcgtcaaatatctccattccgatattgatacgttagagcgcgcggagattatccgcgatctgcgtctggatgtgttcgatgtgctggtgggcatcaaccttctgcgtgagggattggacataccggagattaccctggtggcaatcctggatgcggacaaggaaggcttcctgcgttctgagacgtcgctgatccagaccatcggcagggcggcgcgcaacagcgagggacatgtgatcatgtatgcggataccattacggattccatgcgtgttgcgatcgaggagacggaacggcgccgcaagatccagcaggagtacaacgaggcacacggcattacaccgacgacgattcagaagtcggtgcgggaactgatctctgtttccaagaagatcgcaaaggaagaaatgaatttcaagaagtctccggagtcgatgaacaaggcggaactgacgaagctgattgccgatatccagaaaaagatggaaaaagcggcggcggatctcaatttcgaggcggcggcggaataccgcgacaagatgatcgaactcaaagggatgctgcgtgacctgtagaaaggataagacaatgaagaaaacgtccgaaagaaaatatattaaaatcagaggagcgaacgagcacaacctcaaaaatatcgatgtggatattccgagagacgaatttgtcgtgctgaccggattgtcgggatcgggaaaatcgtccctcgcatttgatacaatctatgccgaaggacagcggcgctatatggagtcgctgtcttcctatgcaaggcagttcctcgggcagatggaaaagccgaatgtcgagaagattgagggattgtcgccggcaatctcgatcgatcagaagtcgacgaaccgcaatccccgctcgacggtgggaacggtgacggagatctacgattacttccggctgctctacgcgcggatcggtgtgccgcactgcccgaaatgtggaaaagagatcaaaaagcagacggtcgaccagatggtcgatcagattatggaactgccggagcgcacgaagatccagttgctggcgccggttgtgcgcggcagaaagggcgagcatcagaagctgtttgagcaggcgaagcgaagcggttatgtgcgtgtgattgtcgacggcagcatgtatgaactgtcggaagagatcaaactggacaagaataaaaagcacaatatcgagatcgtggtggaccgtctcatggtaaaggaaggaattgagaagcgcctggcggattccatcgagaatgtgcttacactggcaaacggactcatgaccgtggatgtgatcggcggtgaaccgattcagttctcggagagcttttcctgcccggactgcgggatcagcatcggcgagattgaaccgagaagcttttccttcaacaatccgttcggcgcgtgcccgacctgtttcggactgggctataaaatggaattcgatgaggatctgatgattccggataaacggctttccatcgcggaaggcgccatccaggtgatgggctggcagtcctgtacagatccgtccagtttcacatacgctattttaaaggcgctgacggaggagtatcatttttcactggagacgccatactgcgaatacccggaggaaatccgccatgtcctgatctacggaacggacggcagggaagtgaaagtccattacagaggacagcgcggggaaggcgtttatgatgttgcctttgagggactgatcaaaaacgtgcagcgcaagtaccgggagaccggttcggaggtcatgaagcaggaatatgagcagttcatgcggattaccccctgcgagacctgtaagggacagcggctgaaagcagagtctctggcagtgacggttgcagataaaaatatttatgagatgacttccatgtcggtgaagaatctcaatgcctttctggcggagatgaagctgggggagcagcagcaccggatcggcgatcagattttaaaagagatccgcgcacgcgtcggattcctgaatgaagtgggactggattatctgtccctgtccagagcgaccggtaccctctcgggaggagaggcacagcgtatccgtctggcgacgcagatcggttccgggctggtcggggttgcgtacattctggacgagccgtcgatcggactgcatcagcgcgataacgataagctgctgggggcgctgaagaatttaaaagatctcggcaacacgctgattgtcgtggagcacgacgaggatacgatgcttgccgcggactatattgtggatatcggaccgggagccggctcacacggtggagaagtggtcgcctgcggtacggcacaggagatcatgaagaatccgaagtcgatcacgggagcgtacttaagcggcagaatcaagatcccggtaccggatgagcgcagaaaaccgacgggatttctgacgatcaaaggcgcacgggagaacaacctgaaaaacatcgatgtgaacataccgctcggaattatgacctgcattaccggcgtgtccggatcgggaaagagctccctgaccaatgagattctctataagcggctggcgcgcgacctgaaccgggcgcgctgcattccgggagagcatgatgcgattctcggcatggagcagctggacaaggtgattgacattgaccagtcgccgatcggcagaacgccgcgctcgaatccggcgacctacacgggcgtgtttgacatgatccgcgatctgtttgcggcgaccccggatgcaaaggcgaagggctacaaaaagggaagattcagcttcaacgtaaaaggcggacgctgcgaggcgtgcggaggggatggaatcttaaagattgagatgcatttcctgccggatgtctatgtgccgtgtgaggtctgcgagggaaaacgttacaaccgggagacgcttgaggtcaagtataaaggaaaaagcatttatgatgtgctggatatgacggtggaggaggcgctggagttttttaaaaatgtgccgtccatccaccgcaagattcagacgctctacgatgtgggactttcctatgtaaaactgggacagccgtccacagagctttcgggaggagaggcgcagcgaatcaagctggcaaccgaactctccaagcgaagcaccggaaagacgatctacattctggatgagccgacgaccggacttcattttgcggatgtgcacaagctgatcgagattttgcggagattgtccgacggcggcaataccgtggtggttattgagcacaatctggacgtgatcaagacggcggattacatcatcgacatgggaccggaaggcggagacggcggtggaacggtcattgcgcagggaacaccggaagaggtggcgcagataccggagtcctacaccggacagtatgtcaagaaatatctggaaaaatagtggaaataaggagaaggcactggacgcaaacgtggaaaacacgcggcatacagtgccttttttgacaacagatgcgctggcatctgcggtcagagaaatgttgtgaaatatatggcatcgaaaattcatatggatgaaaattcgttatacccggggagtacctcccggcgtttggtgtttgcgccggaaggtatgagttatgaaaaattatactaaccgcggaatatttgaggaatatttccggggcggtgtatgtttggtacaccatttagtacgtaaaaaaatataacccgcaaatgtgatgaatacgtgataaaaaaatgaaaaaatatgatattccggacaaaaaatgaagaaattcttatttttttcaaaaatggcggcacgggcgaaaaaaagctttgaaaaatcccagtttttgtatataataatgctgtatatgtaaaaatatgattaaatgcatctttatgtccttttggacgtgaagaaagattcaacgaatagatgaaccattggcagagaaaagaaaggggcagattagaatatgatgagtacggacatcggtatcgatcttggtactgcaagtatcctggtatatattaaaggcaaaggtgtagtgttaaaggagccgtcagtagtggcttttgatcgtgatacaaacaaaatcaaggcaatcggagaggaagcgagactgatgctcggcagaacgcccggcaacattgtagcagtccgtccgctgcgtcagggtgttatttctgattatactgtcaccgagaagatgatcaagtatttcatccagaaggcacttggcaagaagacattccgcaagccgcgcatcagcgtgtgtgtgccgagcggagtgaccgaggtcgagaaaaaagcggttgaggatgcgacctattctgcaggtgcgcgtgaggtggcgattatcgaggagccgattgcggcagcgatcggagccggaatcgatatttcaagaccatgcggcaacatgatcgtggatatcggcggcggtaccgcggacatcgccgtgatttctctggggggatcggttgtcagcacttccatcaagatcgccggagatgattttgacgaggcgattgtccgttacatgagaaagaaacacaatctgttgatcggtgagcgcacagcggaggacatcaagatcaagatcggttcctgtttcccactggcacagaatgagaccatggacgtcagaggccgtaacctggtgaccggtctgccgaagacggtaaccgtttcttccgaggagacggaagaggcgctgaaggagccgacactgcagatcgtggaagcggtacactcggtgttagagaagacgccgcctgagcttgcggcggacgtggcggaccgcggaatcgttctcacgggaggcggatcactgcttcgcggacttgaggaactgatcgaggacaagacgggcatcaataccatgacagcggaggagccgatgacctgtgtggcagtcggaaccggaaagttcgtggagttcctgtccggaaagcgcgacgatgattaagtttgacggcagttatgacgatataaacaacagagagcccttgggatgcgggagcgtctgatggattctggtgagaagcaggcagaagttacaagaggtaacagaaaaaggagcagtctatggtaaagggattgtatacagcgtatacaggaatgataaatgaacagaagcgtctagatgtgctttccaacaatcttgcaaatgcagatacgaatggttataagaaagaaggcacaacgtcccagacatttgcagatgagctggcaatcaagatcaaagatacatcgtcttacggtcttgcgcagaagctgggtacaatcagcatgggcgttcatatcggtgagacgtatacggattacagtaccggaagtttcaaggttaccgataacagtacggattttgcaatcaagggagatggattttttgcgattgcctacacggataagcagggaaattcatccgtaaaatatacaagggacggagcgttcacggtcaacacccagggctatctggtgaccaaagacggcgattatgtcctgaatgcaaatgacgccagaaacggcaatgtgaacggacggattcgggtggatccgacccagaagatcaccgtggatgagcttggcaatatctatcagaacgatcagcaggttggaacgatcggcatcgtcgattttgcggattatgactatctggcgaagtacggtgagaatatgtacgaccttgtgaacggaggaacggtgacggcggcagacggcaggatcgtgcagggaacgctggagtcgtccaatgtgaatgttgtttctgagatggtcaatatgattacgatttccagagcatatcaggcaggacagaaggttattaacacgattgatgagacactggataaggcggtcaatcaggtcggaaatgtatagacggaggtagctgacatatgatgagggcactttatactgcggcaaccggtatgcttgcgcagcagacgaacgtggacaatatttcaaacaatctttccaatgtgaatacggttggattcaagcaggagaaggcagagtttaagtcgctgctttaccagaccattcagacgaagacaacgagtgcaaacggagagcagaaaccgattccggcacaggtgggactcggaacgagagttgcggcagtcacatccgtgtacacacagggagcgctgcaggcgagtgagaatgataccgattttgcaatcgtcggagacggattttttgcagtgcgctgcgcagacggcgagacacgctataccagagcgggagattttgtgtgggcagtgggaaccaacggcgttacactgaccaatccggacggctatccggtgctggacagcaataaccagcagatcgttcttccggccaatataagttccagcagtgtgacagtatcgagcgacggcagaatcggttacacgacagcaaatggaacttatgtgaatatgaaccgtcagattggactgttccagtttaacaacccgagcggccttgagaaaacgggtgacaaccttctggaagttacagcagcttcgggtgcggcaatgaatgagaatacgacagcaggtcttaccagaagccaggttcgccagaattatctggaggcgtccaatgtacaggtggcggacgagatggtcaatatgattatcgcacagcgtgcctatcagttgaactccaaggcaatcacgacatcggatgagatgctggagatggcgaacaacctgaaacgataagcagatgataagcgaacggtaagcggatgataagcggaatggagcgtaaagtatgagtttttcgatagacggtatttcgtcattggtcagcaatgcacagaacagcgcagccgcaggcagcgcgtcggcactgaagaattcgatcagtagtgtgtcctccggctcgagcgaggaagaactgctctcggtctgcaaggattttgagtcctactttgtggaagaggtattaaaggaagtaaaggagaatctcatttcggatgatgacgaggataaggattcttctctcagtacgctgacagattttcacatggacagcacgatcgaactggtggcagatgagattgtggatcaggtgggagaaaattatacgcagcagctttatgagcagatgaaacggaactatggcatagaatagatgccggcagttaagaatgaacgaggcagagggcggtcaccgttagaggtgacgggttctctgcttttttcggcgggaggaatgatttggaaaagttagcaggatatgtggaacatattatatacagaaatgcagacaacggatatacggttctcaatctggtaagcggggaggaggagattacctgcgtgggaatcttctcggcaatcgctgagggggagaacatcgaggcatccggtgactataccgatcatcctacttatggcaaacagtttaaagtcgaaagttttgaggagaaagcgccggaagatgaggaagccatcgaacgctatctcggttccggggcgatccgcggaatcggtctggcgctggcagcgcggattgtgcgcagattcaaggcggatacctttcggattatcgaggaggagccggagcggctggcggaagtaaagggaatcagcgagcgcaaggcgatggagattgcggatcaggtgaatgaaaaacgtgatctgcggcaggcgatgattttccttcagcagtacggcatcacgatgaacctggcagtgaaagtatatcagcagtatggacaggaggtatacgggattatccgtgagaacccgtatcggctggcggacgacattgagggtgtgggattccgcacggcagacgagattgctgtccgggtaggaatccgcatggattctgatttccggatccggagcggaattttatatgtgctgcttcaggcatccacagaggggcatacctacctgccggaggaggaactgaccagaagaactggacagcttcttgaggtcggggaggagcagatcgagaagcagtatatggatctggcgatcgagcggaaaatcatcatgaagcagggcgaaaaccagacgcagatctatgcggcgtccttttactacatggaggcaaatacggcaaccatgttaaaacagctcaatgtcagctatgatgttccggatctggaaatcgaggagcgtgttcgcagaattgagaagcagaccggaatggaactggatgagcaccagatgacagcggtcaaagaggcggtgcgcaacggacttctgattatcaccggaggaccgggtaccggaaaaacgacgacgatcaatacgatcatcaagtattttgagatggaaggacttgatatttttcttgcggcgcctaccggacgtgcggcgaagcgcatgagcgagacgaccgggtttgaggctagaaccatacaccgcatgctggaactgaacggcggtgtggacggtgcggcagggtttgagcggaatgagcagaatccgcttgagacggacgttgtgattatcgacgagatgtccatggtggatatttctttgatgcatgcactgttaaaggcggttgctgttggaacgagactgattctggtcggagatgtcaatcagctgccgagtgtgggaccgggaagtgttctgcgggacattattcgctcgcacgagtgcaatgtggtcatgctgacgaagattttccgccaggcatccacgagcgacatcattgtgaatgcgcacaagatcaatcagggcgaagaagtgacgttggacaacaaaagcatggatttctttttcctgaagcggtatgacgcggatgtgattatcagcgtggtattgcagctgatcaagcagaaactccccaaatttgtggacgcgacgccgtacgatatacaggtgttgacgccgatgcgcaagggactgctgggcgtagagcggttaaacggaatactgcagcgctatctgaatccgccgtctccgcagaagcgtgaaaaggaacacggcgatattctgttccgcgagggggacaagatcatgcagacacggaacaactaccagttagagtgggaaatccgcacaaaatacggtctgtctgtggataaaggaacgggagtattcaacggagacatgggaattgtccgggagatcaacgatttcgcggagacgatgactgtggaatttgatgagggcagaatggtggaatatccatacaaactgctggatgaactggaactggcgtacgcgattaccatacataaatcgcagggaagcgaatacccggcggtcgtcattccgcttttgtccggaccgtcgatgcttatgaaccggaatctgctgtacacagcggtcacccgcgctcggaaatgtgtgacgctggtcggcaatgaggtgacgtttgagcagatggtgcagaacacgtcgcagcaaaaacgatacagcgggctgtgtgaccgactgaaagaggcatagcactgccgcagttacagaacatttcgcgtttggagaggggaatacggagaatgataacgcaggcgagaagcccatttgtttcagaatgcaacggacacagtcccttctttggagcaaaatcccgtatttcttccgtgcgatcgttgtcttaggttccgtgtctttgccacgtttgaacaccccacggaagctgtccgtcaagcagcagacaatgagcggactttctggcagcactaactgcactcacgcatagacatcataaaaccgcgcgaaccggaactcgccggcatctgctattgaaaatagggcagatgccgactcagacatcggcttcgcgcggttatgttttatgcttagagtgcaggtaagtgctgcacaaaagtcctaaaattgtctgtagcttgaggacagcttccgcgggggtgctccaaacttggaaagacacggatcatcgcaaaggcaacggccgcacggattagaaatacacgattttgcgattagaagggattgtgcccgttacatcctgaaacacaaaaggcttccgcctgcgctcacttcatccggacagcttctcctcccgaaatatcctgcgaccgcgttatgcctctttcctgcggttacgacagcagcgctttatcgtttgcaaactcctcgccgctgaccttctcaaactgatggaggagatcttccaccgtcagcttcttcttctcttctccggcaatgtttaagatgacccggccttcatgcatcatgatgaggcggttgccgtgtacgatggcatccttcatgttgtgggtgaccatcatggcagtcaggtggtgatcggcaatgatcttgtcggaaatctcaagcactttggctgctgtcttcggatcgagcgctgcggtgtgctcgtctaaaagcagaagcctcggcttctggatggaagccatgagcagcgtgattgcctggcgctgaccgccggacaacagccctactttgctggaaagccggtcttccagaccgagatctaacgtggcaagcatctcacggtagacgtcgcgctccttttttgtgatgccccaggagagcccgcggctctgtccgcgtctggcggcgatcgccatattttcctcgatcgacatcgtcgtcgcggtgccggtcataggatcctgaaagacgcgtccgagatatttggcgcgcttgtactcggaaaggcgtgtcacatcatcgccgccgatatagatttttccggaatccaccggccacacgcctgcgatggcgtttaaggtggtggattttccggcgccgtttccgccgattacggtgacgaaatcgccctcctcgagagagaggttcacaccgtttaatgcaactttttcgttaatggtgcctggattaaacgttttcttgatattgtctatttttaacatttctgccatggtgttaccgctcctttcctttgcgtgtggatttcagataaggaatggcaaggaatactgccacaacgatcgcggagaaaagcttcagatcgtcggaaggaagctttaaccataaaaccacattcattacaatataatagatgatcgctccgccgattacggaaaacagcgtgtaggcgaaagcgagattcttcccggcgcagagtctgccgaaaaggacttccccgatgatgacggcggcgagaccgatgacgatggcaccacgtcccatgttgacgtccgccgcaccctgatactgggcgtagagaccgccggaaagcccgaccagaccgttggagatcatgagcgcaatgacggtgtgaaggttggtgttgattccctgcgcacgcgccatttgctgattacatccggttgcgcggatggcatgtccctgctccgtgccgaaataccagtagagaatcgcaacgattgcaaaacagaacaggatgcatgtcgcaaaaatctgcacgcgggtgctgttggagtcggacagatagcggagcgagaccaccagagggtacttgtcaacactgacggcctggttggaacagcccatgatgttcaggttgatggaatacagggaaatctgggttaaaatgcttgccagaatgcccggaatgccgagagcggtatgcaggataccggtgatgaaaccggcggccatgcctgccagaaaggcaaaaataagtgctgcccacggactcatacctccgcggatcagcatgacggcaaccgcacctccggttgcaagagaaccgtctacggtcagatccgcaaaatccaacagacgataggtgatatagacaccgagtgccatcagtccccagaccatgccctgggcgaaagcgccgggcatggaacggaagagggcaagcgggtcaagcgacataaaataattcatcaggaaaaacccccttgtaaggaaaaatattattcggcatcaattgccacgtaatcatccggaaccgtgatgcctaaatcggaacagatcgcggcattgtactctttggtgacattcggggcatattcaatatccattgtggatatatctttgccgtttaccagaatgtcataagccatctcgcccgctttgtagccgatgtcgtaatagctgatggagagcgtcgcaacgccgcagccggaacagattccttcttcgccggcgatgacgggaatgcctgccgggcgtgtgatgttgtcgatcgcttcggtgttgcctgccatggtgttgtcggtcggaatgtagatgacgtctacttcgctgacagcactctgtacgacagaggcgatgtcgttggaatctgccacggtgtactccttgtgggagattccgtcctcatccagatactttccgaattccgttgcctggtacacggagttcggttctgcggaacagtagaggatgccgacattcttggcgtctggaaacagttccacgagcatatcttcctgctggtctaacggagccagatcggaggtgccggaaatattttttccggtggcgccggtccagtcgtcaatgtcgagcgcggttgcgtagtccgtcacggaggttccgagtaccgggatcgtgctggtggccgccgcggaagcctgcagggcggtcgtcgcattggcgaggatcagatcgtaattgttggagacaaaggtggtggcaatgctggaacagttcgcctgctcgccctgtgcgttctgcacatcgaaggtgacggaatcgcccatcagtttggtcagggcatcctgaaatccctgcgttgcctgatccagtgccggatgctccagctgctgcaggatacctaccttatacgttttttctccactgccgcacgcggtcatggataagaccatcgtggagactaatactgccgaaatcagtttgtgtgcttttttcataagcatctcctcctttattgcattaaagctttaatgcttttaatagataaaattataatgaggaaaagtatattcgtcaaccgttccttaaaataaagaaagaaaaaattaagaaaatgtttatggcaaaaaaggggcggacatgctaggataaagcggaatcagatgaccggggggagagcgggaaatgcaatgcaggctgatttcgcaacaggaaaagaaaaaacaggacgcggactgcggtgggggacggagacgatcgttggtctcatctatccgccgagatgtccgatctgcgaccgcgtgacggtgccggaatgtgtcccgtgcagaaggtgcgcggatgctgtacggcttgccgaggaaccggtgtgcaagcgatgcggcaagccgctggatggcgagcgggcggaattctgtctggactgcggaaagcgcaggcatgcgtactgccaggggaaagccgtgtttgtgtatcagggaaatatccggcagtccatgtaccggtttaaatatgcaaaccggcgcgaatatgcggcgtattatgcgagggaggcggcagcgctttatcaggactgggtttttaaaaatcaaatcgaagtgatcgttccggtgcccatgtaccggtggaaaaagcggcggcgcggatacaatcaggccgagacattcgcgcgggcgcttggcagggagctggggcttcctgtggacgccgggcttgtgcgccgtgtgcggaacacggtgccgcagaaggagttaaatggcggacaaagagcggcaaatttaaaaaatgcttttcaattagcagcagatatagtaaaatataagaaaatattgctggtggatgatatttatacgacgggaacaacgatagataccgtttcggaggtcctgctgaagggcggcgcagagcggatctattatatttgcgtcagcatcggtgcgggattttgacaggggaattcaggaggattgagaagtatggaagtgagaaattgcaggagctgtggacgcctgtttaactatatggggggagcgccgctttgtccggcgtgtcagaaaaagcttgaggagaagttccaggaggtaaaggctttcctggaggagaatccgaattcaagtgtggagacggtcgctgaggagctggatgtgtcggtgaagcagatcagacagtggattcgcgaggagcgtctgtcactttccgtggcaggagcagacggcattgtctgtgagacctgcgggaagccgatccgcacgggaagattttgcgagaagtgcaagaacaatatggcgaacgcgcttgcagagtcgattcataagccggagccgccgcaggagacagagcgggataaaaaccgcatgcgttttctcaaataataccaagagaatcaacagggcctgggtatcgggctctgttttttgctttgaaaataaatagtgctgtgttataataaaaaaagaatgcataattgcgtgcaattttgacctgcgcaggctggaacggcagggcggagaaaggataactactgtatggtaaatgaagaacgattgcgccacctgattaagatggcacagtttgatacaaatgacgggaaacagtgtaagccgatgacgcagtatgcgagaaaagattatgtttccatgcgtctgctggggagcttcgtgacaggaaccatctgctacgggcttctgatgggaatgtgggggctgtatgcgacggaagagctgcttgcaaagctgaacaagttcgatatccaggggcttgtcatgacagcggtagtgccgtatctggtgtttatggtgatttacctcggagccacgtgggtaatatttaacatgaaatacacagagggacgccgcaaggtgaagaagtattacaacaacctgaaaaaggtgaatcagatgtatgagagggaagaacgcctccggacatccgatcataaagactgggattagagcgggaggcatggaatgacaaccttattggaactcaaagaaaaattagtacgcttctacggaaaatacgaagtgtacattacaccgatcgtcaagtttatcgtggcgtttgcggcgctgatgacgattgacaggaacatcggctacatggaactggtcagctccacaccggtggcgctgattttaggactgctctgtgccatcctgcctgtgggcggcacgatctttattgcggcggtcgtcatactggcggatatgtatgcattatcgattgaggtatgtctggtcgcacttcttctgtttgtgctgatctattttatctattttcgttttgctcccagacagggaatgggcgtattgctgacgccgatctgcttccggctgaatatcccgtatgtgattccggttggaatgggactgctggaggaggcatattctgtatttgcagtgatctgcggtacggtggtttactttttcctcgacggagtccggcagaatgaaaagctgctcggcggtgcggcggaagagagcacggaggcgaattccaagattgtggtggcgttaaaccagcttctcggcaacaaggaaatgtatctcgtgatcggcatcatggctgtgacgctgatcattgtgtatctgattcgcagaatgtccattgcgaatgcatggcagattgcgattgcatccggtatcctgtttgagacgataggtttgattgcgggctatatgcttcttggaatttccggtaagacggtgagcgtgctggtgggcaatgtaatctctcttctgattgcatttgtgatacagtttttgttctttaacctggattactcgagaacggagcggttacagtttgaggatgatgagtattactactatgtaaaagcagtgccgaaggctgtggtatccggcaccaacaagcaggtaaagcgtttcagcgggaaggacgaaaaggaacgtctcacgaagaagcgttttgcggaagagatggatatcgacgaagaattattagattaaggaagtggaccgcgtgcagaacatgttagctaccctcgatgctttctggcagaaagcgtctctttatatgaatcttccaaaaatctccataacagatatcgtggagatcataatcatagcgtttctgatctactatatgctggtgtggatcaagaataccagagcatggatgctgctgcgcggtttgatggtgattctgctcttcgttctgttggcagcattgttccagatgaacacgatcatctggattgcaaggaatacgttaaatgtcctggtgatagctctggttgtaatcttccagccggagatgcgcaaggcgcttgagaatctcggacggaaaaacgttctggcgttcctgttttcctttgattcctcaaaggaggatacggggaagttctcggataagaccattaatgaaatggtcaaggcgtgctacgagatgggaaaggtgaagaccggagccctgattgtggtggaggatgagattgttctctcggaatatgagcgcaccggaatcgcggtggacggtattctgacaagccagcttctgatcaatatttttgaaaaaaacacaccgctccatgacggcgccgtgattgtgcgcggggacagagtcgtggcggcgacctgttacctgccgcttacggattccctgtcgatcagcaaggatctgggaacgagacaccgtgcggctgtcggaatcagcgaggtgagcgattccctgacaatcgttgtgtcagaggagaccggaagagtgtcgattgcgctcggcggtgaactttaccgcaatgtagatgccgagtttctgaagaacaagctgacgtacatccagaggcgggaacgggaattatcgaagattgcattgtggaagaggaggctgaaagatgctaaaacggctcggaaaaacgataacaaataattttagcctcaaaatactggcggtcatactggcggttgtgctgtgggtagtcgtgattaacattgacgatccgacgacgtcaaagacctataccaccaatgttgtagcggagaatacggactatatcacatcgcagaacaaatattatgaaccgctggacagcagcaacgtagtgtcattccgcgtgtcggctgcgcgcagcgtgcacgatgaattatccaatgccgatttttccgcaacggcggacatggagaatattgagtacgatgagggaagcggaatttaccgcgtgccggtgacgatcaccgcgaagcggtatagcaataaagtctccgtcgtctccaaacagctctatctggaagtggcgctggaagaccgcggcacctgccagaaggcgattacggcggcaaccaagggaaccgtgatggacggctgtgcactcggcacggtacagatcgtgggctccaacctgttaaaggtttcgggaccggcatccatcgtcagccagattgatacggcggtggcgacgatcaatgtggaaggtatgtccacggatgtgacggattccgttgtgccggtgttatatgatgccgacggcaacgtgatcgacacgacaaagctgacactcagtctgtccacagtcaatatttcggcacagatcttaaataccaaggatgtgccgctggagtttgaggcgaagggcgaaccggcggacggctatgtgcttaccggcgtggaaagcagcctggataatgtgcgtatcaagggcgaggcggcaacgctcaataccgtcagtaagatcaccattccgcaggaggtgctggacatttctggtatcaccgaggatctgaccacaacggtggatatcagttcctatctgccgagcgggacgtcccttgtgctgaattcggatgcaaaagtagaagtgatcgcgaaggtggagccggttgtcaaggcgacttacgaggtgccagtggcaaactttaccattcagaatgtgcgcgacggttacaatgcaaattacatggagagcacggtcgcggtagagatcagcggagcggagagcgagcttgcgggaatctctgcaaaagatattaccggaacggcggacgcatccaaccttggagcgggcgagcatcacctgaatgtgcagatcacgctggagcaggagcactgctgggtgattggaacagtgacactgccggtgacaattaccgaccacaacaccgccgaaacgggtacttcggataatacggatacgacagacagtgagagcaagacgaacgatacagccgacaccgccgctgcaggcgatgcggctgacaagtcggataaaaccgataagacggataagacggataagacggtcactgagaacagtacggctggaagtgatgtggagagaagcagcaacaatccgtaaaaagtaagaaacatggaggaaatagaatatggctagaatgtttggcacggatggcgtgcgtggcgtggcgggatcggaactgacgatcgaactggcaaccaagcttgggcaggcaggcgcgtatgtgctgacgaaagagacggaacatcaggcgacaatcattgtcggatgcgataccagaatatcgggaggaatgcttgccagcgcgttgatggcgggaatctgctccgtgggtgcaaacgccatttttgtgggggttatgccgacgccggcgattgcctatctgacaagaaagcataaagtagatgcgggtgttgtgatctcggcatcgcacaatccgatggaatttaacggaatcaagttcttcaacggcgagggctacaagctttccgatgcactggaggatgagattgaagcgctgatccgcaacaacatgaaggacgtggtacttccgatcggatccggcgtgggaaagatcgaataccgctttgatctgaaggatgaatacgtgaaatttatggaaaaatgtgttccggtcgatctgcacggcaaaaagatcgtggtggactgcgcggagggcgcgtcgtattacacgtccgtcaaggcgctcagcgatcttggtgcggaactggtggcgattcacaccgacccggacggaaccaacatcaatgcgaactgcggatctacccacatggatgagctgaaggcacgcgttgtgtacgagaaggcggatgccggtatcgcgtttgacggcgatgcggatcgtatgcttgcggttgacgaaaagggcaatctggtagacggcgatcaggtgatggcaatctgcggcaactacatgaagcagaagggcagactgaagaagaatacgattgttgtgacgatcatgagcaacctgggatttactctgatgggagaaaaagagggaatccacgtagagaaaacaaaagtcggagaccggtatgttctggagaacatgcgggaacacggatacaatatcggaggtgagcagtccggacacgttattttcctggatgacaatacgaccggagatgggcttttgagcgccctgcatcttctggaagtgatggtggacaccggaaagccgttgtcagagctggcagcgatcatggaggttctgccgcaggcgcttgtcaatgccaaggtgccgaatcacaaaaaagagcattttatggagtatccggagattgcggatgcaatcacagaactggagaaaaagtttaacggtgagggacgcgtgctgatccggccgtccggtaccgagccgttggtgcgcgttatgattgaggggaaagatcagaaagtcattgacgaggaagcgaagagacttgcggaattgattacgcgcattatgttgtagagtcagaggatttgttaggaaaattattcattggagggaagagagcatggtaagtcagaaagtcacagtcaagaatccaacgggactgcatcttagaccggcgggaatcctgtgcaaggaggcgatgcagttcaaatcgcacatcacattccgataccgcgagaatactgcaaatgccaagagcgtgttgagtgtgctcggtgcatgcatcaaatcgggcgatgagattgagctggtatgcgagggggaagacgaacaggaagcgcttgcggcgcttgtgcatgccattgagaacggacttggagaatagaagagtaagagaggaaaaccggatgaaaaagatactggttaccggctgtaacggtcagctggggcgcgcaatccgcgcagagtatgcaaaggaagacgtaacgtttatcaacacagatgtggtggagggcgatggtgtcacagcacttgacatcgccgatgtggatgccgtgctggcgcttgtccgcgccgagcgtccgcaggttatcatcaactgtgcggcgcacacgaatgtggatgcctgtgagacacagtgggatgcagcgtaccgcatcaacgcgatcggtccgcgcaaccttgccatcgctgctgcggaagtcgacgcaaagctgatacatgtgtccacggattatgtgttcgccggaaacgggacgagaccgtatacggaattcgatgagccgggcccggtcagcgcatacgggaaaacaaagcttgaaggagagcgcttcgtgaaggcgttcgcaagaaaatattttatcttccgcacggcatggctgtacggggacggcaaaaattttgccaagacaatgttaagactgtcggagaaccatgaggaagtgagcgtggtatgcgatcagctcggttcaccgaccagcgcagtggaacttgcgcgtgcgattcatcactatgaaccgacggagaattatggactgtttcatgcaacctgcgagggagataccaactgggcagcatttgcggaggcggtatttgcgcgtgccgggaagaatacctgcgtcagacatgtgaccagcgaggagtatgcagcgatgaatcctgcttcagcgaaaagaccggcgtattccattctggataattacatgatgcgcctgacggacggctatcgtatggctgactgggagagcgcgctggatgaatatatgcagcatttgggctgagagagataccgacagaaaagtgaaaggataaccggaacggatgaaaagtgttgtaatgcgggatttgcatgactatgtgagaaaatactgggggctgcttgctgcgtcaatggcggcaatgctgatctgtttcggttgtcttgttttttgcggaaatatccgcattgatacagaagagttaatcaatcacccgggaagcagtctgggatggcttgcgatcggacggtgggagctggcgtggctcaagcgccttctggggcttggcacacatcaggtcataaaaagcggggtattgttctttctgtttttctggctgggagccaatttcctgacgttcggcatttatgagcgttccgggaaaaagaaaagccggtactggattttcctgctcctttatgcaacgtccaacatctggtgttatcagatttacttttccctgcagcaggcggaggtggcgcttgcaatgctgctgttgattgcagcggcgtttctgatgaccggaatcggcaccggaaccgtaatgaatctgcttcgggcatttgcggcgggtgttctgctgtttatcggacttggagcgtatcaggcgctggcggtttattatgtcgcagtgtgcctggttttcttcctggcggagctgaccgcggagcaaaagaaggacggatacctcaggcagatcctctggatgatcgcacatttcggtgtggtgtatctgtgctatcactggtatatgagcacgtttctggtgtcttcggattatatggacagccagatgggctggggaaggctgcctgtgctcgcatgtatcaagaatgtgctgcgcacgctgaaaaatctgctgctcggccatggacccagaaacttctctttttacggatgtggtgtaattctcctgcttgtgcttgctgggagcgcgtttgcctgccggaaaaagcggaatcttccgtgggagaagaaaaagatcgtgtatgcattgctggggctcgcgggacttgtgcttacgccgctgcttctgacggcatacatgggggagatgatcgtgacaagatcacagtttgcacttccggtggcgggagcgttcctgggaatgtatgtgacggaacgactggcggaactctgggatgcaagagaccatggtacgggttactggctgctgttcgtctgcagagtgtgtatctgcgttgcgattgcggttcaggtgagttacgatctgcgtcttaccgtgacagatgagatgcgctgcagggaggatgagcaaaagacacagcagctgttagaatgccttgccggggcagacggaggggaactgccgcggcttccggtagtgtttgtcgggtatcaggaggcggatctcccagagtggtgcaggcggactgagatgtatggatggtcgttctatggctgggattacagcatggagaatccgaccggtacgacacaccgcatctgcggatttgtacaggcttacactggcaatgtgctgcgggaagatgcgacggaagagcagaagaagcgtgcggtggaactggcgggacagatgaacgatttcccggaagagggatcggttctggtgacggaggattgtgttgtcgtgcggctgtcggagattaaggagcagatgcggacagactggtggtagaggcgatgtggtggtctgtgtatacacaagcttgtgctggaacggaatctatgataaaatgaagagacttatggcagtgaaacggccatggataatagagactgcaagtattgaaaataaatggaggttgagatgagaacttatttggtaacagggggagccggttttatcggttctaattacattcactacatgtttcgcaaatacggagatgcgatccgcattatcaatgtggatgttctcacgtatgcaggaaaccttgagaacctgaaggacattgagaacaatccaaattatacgtttatccgggcggacattacggataaggaagccattgcgaagattttcgcggagaacgacattgaccgtgtggttcacttcgctgcagagagccatgtagaccgcagtatcaagaatccggaggtcttcgtgaagacgaacgtgctcggaacggcagtgatgttaaactgcgccaaggcggcatgggaacttccggacggaacatttaaggcggacaagaagtttttacacgtatcgacggatgaggtgtacggctccctggaggatgacggatcttatttttatgagacgactccgtacgcaccacacagcccgtattcagccagcaaggcatcctcagatatgttggtaaaggcatacattgatacttacaagttcccggcgaacatcacaaactgctccaacaattacggaccgtaccagttcccggagaagctgatcccgctgatcatcaacaatgcactgcagggcaagaagcttccggtgtacggcgacggtaagaatgtgcgtgactggctgtatgtcgacgaccacgcgaagggcatcgatatggtgcaggaaaagggacgcctcggtgagacttacaacatcggaggacacaacgaaaaacagaatatccagattattgagattattattgataccttacaggagatgcttccggcggacgatccgagaagaaagctggtaagcaaagatctgatcacttacgtggcagaccgcaagggacatgacagacgctatgcaattgcaccggacaagatcaaggcagaggtaggctgggagccggagacaaagttcgaggacggcatccgcaagacgatcgcgtggtttttcgagcacgaggactggatgaagaatgttaccagcggtgattatcagaaatattatgaggatatgtatcagaacagatagttgatgcaggcagcagtaccgccttttgggcgatactgcttgtttgcgttttaaattaagaaaaaattaagctgtgtccgttacaaatgttaatggacgtggcgtatattggataaaatgggaggattttcagatgaagggaataatacttgccggaggctccggtaccagactttatccgctgactaaagcgatttcaaaacagatcatgccggtgtatgacaagccgatgatctactatccattatcaacgttgatgcttgcgggaatccgcgaggtgttaatcatctccacaccgcgggatctgccggtgtttgaggagcttttcggagacggaagccagctcggcatgagtttttcctatgcagtacaggagcagccgagaggtctcgcggacgcatttatcatcggtgaaaaatttatcggaaatgatgcggtggcactggtgctcggcgataatattttctacggacagagcttttccaaagtgttaaagagcgcagcggagcgcacggaaaaggagcagggtgcgacgattttcggctactatgtcagagatccgagagagtacggcgtcgtggaattcgatgagaatggcaaggcgctgtccatcgaggaaaagccggagcacccgaagtccaattatgcagtgccgggactttacttttacgataacaatgtggtggagattgcgaaaaacgtcaagccgtccgcacgcggggagatcgagatcacctcggtcaacaacgcttatctggagcgtggaacattgagcgtggagacgcttggaagaggattcgcatggctggatacgggaaatcacgacatgctgcttgccgcggcagattttgtgtctgcattccagaaacgtcagggcttatacatctcctgcattgaggagatcgcgtataagcgtggttttatcgacagagaccagctcatcaagctggcacagccgctcttaaagacggattacggcaaatatctgatggaaatcgcggagggattatagaacatgggtaagatcaaggtaacagagaattgcaacggcattgagggactgaaggtcatcgagccggcagtattcggcgatgcgcgcggatattttatggagacttacaattataacgattttgcggaggcggggattgactgccagttcgtgcaggacaaccagtcagcatcgaaaaagggcgtgctccgcgggcttcattttcagatcaattatccgcaggacaagctggtccgtgtggtaaacggcgaggtgtttgacgttgcggtggatttaagggagggatcgaagacgttcggcaaatggtacggcgtgctgctttccgcggagaacaagaagcagtttttcgtgccgaagaattttgcgcacggatttatcgtgctgtcggaggaggcagagttctgctacaaggtaacggacttctaccatccgaacgatgagggcggtattctgtggaatgatgccgaggtcggcgtggaatggccgatgccggaaggaatgacagcggcggatctgatcttatccgacaaggataaagtgcagaaaagcttcgcagaatataaggcggcgcacggcataaagtaaggaaaaacatgcgcctgcagagggatagaaagagattaggagaacatagatggcaggaaagaagaaggatacatcactgcttcatcatctgatcggaagtagaagcctggtatggaatctggcaaaaaatgacatcaagaagaagtttgcaggctcctactttggtgtggtctgggcgttcgtccagccggtaatcacggtgcttttgtactggttcgtgtttgagaagggactgaattccaaggcgacggatcttaggaccggaattgagattccattcgtgctgtggctgacagcgggacttgtgccgtggttctattttcaggaagcgctaaacggcggcaccggtgttctggtggagtacagctatctggtaaaaaaagttgtgttccagatcgatatgctcccagtggtaaaaatgatatcggcgctgtttacgcatctgttttttgtggcgtttacgattgtgcttttcatctgtatgggatatatgccggactggtatgcgctgcaggtcatatattattcgttctgtatgattctgtttgcgacagggcttgtgtatgcgacgagtgcggtgacggtatttttccgcgacatgaaagaagtggtgggaatcctgttgcagattggcatgtgggtgacgccgattatgtggaactttgagacgatggtgcagataccgggatgggcgattgccgtgttaaagctcaatccgatgtactatattgtttcgggataccggaacgcgctgatcaatcatatcggattctgggaggatatggggcttaccgtatatttctgggttgtgacggcagtgctactgtttctcggaacgactgtgttcaagaagctgcgaccgcattttgcggatgtattatagagaggaatttgtaactgaatggatgagttagcaatcagggtagaagatgtcagcaaggtataccggctatacaacagaccctcggagcggctgtttgacgcactggggcttgcgggaaaaggcagattcaaagaacatcgggcactcgaccatgtcacgttcgatgtgaaaaaaggtgagacggtcggaatcatcggaacgaacggctccggcaaatccaccatcttaaaaattatcacaggcgtgctctcacccacaagcggtgaggtcgagatcgacggaagaatctcggcgctgctggaacttggcgcaggctttaacatggaatacaccggcatcgaaaacgtatatctcaacggcatgatgctgggattctccagggaggagatggatgcaaggctggacgatattctgaaatttgcggatatcggtgaatttgtaaaccagccgtgcaagacgtattccagcggtatgtttgtgcgtctggcgtttgcggtggcgatcaacattgatccggagatcctcattgtcgatgaggcgctgtcggtcggagatgtgtttttccaggcaaaatgttataaaaagtttgaggatttcaaggcggagggcaagacgattatttttgtcagccacgacatcagcagtgtggcaaaatactgtgaccgcgtgattcttttaaacaagggcgtcaagctgtcggagggaaatcccaaggacacgatcaacctgtacaagaaagtgctgttaaatcagtcgcagaatattgcgagcggacaggtgcttgcggacgcgaaggaaaatgggacaaagaagctgtggaaatccaactatgagttgaatccgcaggtgaatgaatacggaaccggggaagcggaaatcattgattttgcggtgattgacgagtacggaagctatacgagctgtatccagaaggggacgtcttttactatccgctcaaaggtgcagtttcacaccgatattcaggatccgatttttacctatacgtttaagaccgtgcagggaaccgctgtcacgggaacgaacaccatgtacgagaaggtcggcgtcggactggcacgggcgggagagatctacgtggcctccttcaaacagaatatggatctgcagggaggcgagtatctgctgtccatcagctgtaccggctacgtgggaggcgagttccgggcgtaccaccggctgtatgatgtggtgggcgttacggttatatcggacaagaatacggttggtttctatgatatgaattcggagacgaccgtggagcgtgtggaggaatagaatatagcacagagagatggaggaaaaaagatggagaatgcacagattctgacagaattgtatgaagttataaaacagaatacaccggatcagtatgccagaatcatcagagagcgggcatcctactcttttttgtaccatttgtcggaaattcgtcagaacctgattggctggctgccgattgacgcgacgaagcgtgtgcttgagtgtaatcccgagtgtggagcgcttacaggaaagcttctttccatggcaaaggaagtagtttgtctgataacggatgacagacaggaacagattctctctgcacggtttgcaacggacagccgcgatgggcgtcttattttcacacgggagattccgacagaaacgcagtcatttgatgtaattcttattgcgggaagtttctaccggtggcagaatcagttgacagatctgagaaatctgctttgtagggatgggtatctctaccttgcagatgcgaaccgtatcgggctaaaatatcttgcagggtgtcaggaagagtatgtgggcggctattttacagggattaatggttattctaatatagattgtgtggagaattctggaaggtcatatacccgcagtgagtatcagagactacttacacaggcgggctttgatgatttgaaatggtattatccctatccggatcacaagtttccgtccgtgatctactcggatgactggctgcccgccgcgggagaacttgcagaagggcgaagtaactatgacagggacagggtcgcatgttttgacgagcgcgtaatggcagataccctgttggcagaaggtgtgtatggaacatttgccaattcatttctgattgtggcagggcaggagggatagagcggttggatagaacgatttattccaaatattccaacgagcgggcagaacgattccgcatccggacagacatcgtggtagatgttgccggaagaaaaacagtatataaatatgccggaacgaaggcggcggatccgcatgtacggcggatagaagagtgcttccggcagctgcaggaagcctatcgcggcagtcggatccgtttttgcccctgtgaagtggaagaattacaggcgggaagccgggtcagctctccgtttgtgaggggggagaccttacagagcatgatcgagcgcagtttccggcagggcgactggagcacagtagagacaatcatacgtctatatggcagacgcttgatggaggcggggggagacagcccgtttactgtgacggaggaattccggaatgtttttggcccggcaggacaggagaatgcgtacatctgtgcggatgtgagtgatgtggatatgatcttttccaatatcttcgtggagacggggaatggcgggacggttttggatgtatcggcagactggaccgttattgactacgagtggacatttccatttccggttcccaagaagtttgttctctatcgtgccatctattttgcttattaccagattttcaaggctcagggaagagacctttcggagtggcttgcgatggtggacattaccgtggaagaagcggcacagtttgcagagtgggagacacattttcaggagtatctgctggaaggaggttttccggtgcgcaatatgcagcgcattatgggaacaaaagtcataccgtttgaagagcttcttgccggagagcagacaacagacggagaagtggtgaaagaatcccgatggatccgggtgcgcaggctgctgtatcatatcgatcgactggaacggcaggatgggagtgtgatctgcagtggatgggcactggcaaaatgtctggacggaaggtgcattccggttaatatccggatatatggtccggatgaaaagcagatccgggcagatgtaacccggagtgaccgggcagatgtggcagaagcgttaaagctccggcgtgtggatcgcccacagtttgggtttgactgtgtgtggattctgccggcaggacagaaatggagtattcatttttccatgggaaaccgtgagatcatctatgagggataaagtgaggaattgatatgtaccaatcaaaagaaaagatccagacagtggtgctgtttctggcggatctggtatgttttgtcatcagctatttcttcggaggttatctgtggctggtgcgttaccggaatgtgtcggtaataaatatgaagaccgagctgatggaaagcttcggagtggtaatggtcatctacatgctggtgcttctgttttcggacattgagaagaattttatacgacggaacctggcaagggattttatggcggcagtggaagccagcgtagtcatgatctttgtgacggcactgacaatttttttgcagcacaataatgcagatgcttcccgtggagtgtatttctgtattgcagtggttaatctgatactgttttttataacccatgccgcgatcaagtattaccttctaaagatctataggaataaaagaggaaccagccagatttttctggtcacaactgtggaccgtgtgctggatacactgacagagatcgaaaatgcgaaggactgggcacaccgcctgaccggaatcgcggtcattgatgacaatcagattggcagatggtatgagggaattccggtcgtggcaacttacgataccatgtaccagtatgtgaaggaacagattgtggatgaagtatttatcaatgtaccttacgatacgggggaatcactggcagaggttgtcaataattttgaaaatatgggagcaacggttcatataacgatcgaactgctgcgtcattttgatgagtatcataagagttttaatatgatgggcaatgtacccgtcgtaacattttccaatcagtattacgactggaaaatgttatttgtcaagcgtctgatggatatcgcaggagcgattgtcggactggcaatcacagcagtcgtaacagtatttctggcaccgccgcttttgatcgagtcaccgggaccgctgttttttgcacagaagcgggtcgggaggaatggtcggtttttcaagatctataagttccgctccatgtacagggatgcggaggagcgcaaaaaagaactggagagtcagaatgaaatgaacggctttatgttcaagatgaaagatgatccgcgtatcacgaaagtgggaaaatttatccggaagaccagcattgatgaactgccgcaattctacaatgtattaaagggcgatatgagtctggtgggaacaagaccaccgacagtggatgagttccggcagtacgaatctcatcagaagcgcagactgagtgcaaagcctggaattacaggactttggcaggtgagtggaagaaatgaaatcaaagattttgaagatgtcgtaaaactggatgtgcagtatatcgacaactggagtattggattggatatcaaaatcatactaaagacgatcaaggttgtatttgaaaaaggtggagaataaggaggcagaatcatatgaaccagaagtatcagttagacagggaatacagtatagcggagattattcaatgtaatctacgcagatggtggcttgcattgatctgtgcagtggtgtgcgcagtagtccttggtggatataagtacaaatctctcgaaccgtatctggagcagaatatttatgagaacgtcagacaggttgtggcaaccttatatgtgcagacgtacagtgatgagagttccactgagcgtgcaaataatctcattcgtatcgcggaaagcaaccgtacctttgaaaaggtaaaagaaaaacttggctgtgatattgactataagacttatcaggccctgtttcggatggcgcaggaagagacaggagatattgtgctgctctatttacagtatccgattgatactggagatttcagtattgcagaggaagaggatgccattgtgtttgcacaggcggttgtggatgcaacagcagagagtgcaacagaacttaacggacaggagtgcttttctgtgatcgatgcaccgtatgcaagtcaggagaataaaaaggtagagaactactttatttctgaggacgatttcaaccgtggtgtgatgaagggactggttgccggatttttattgggaattattgcagaagtggcattatactctttttggcttgtgttatatagaaaaccaaagagtgctgaggaggtatgccagattctggacgtgccggtgattgacgatgtgaaaacacgaaaggtcagtgaggaggaagtatacaaaaaggtttctttattcttacgaaagcatatgaaagaaagaacaaacggatgcatgcgcattaattgcattccgattggaaccgtgaggagagacgctgctttaaagcttgcattcagctgcgcaaatgagcagaagaaaacactgtttatagatctggctatcgatgcagagggaaaagatgcgaaaaattcaattagtcaatatattcttggggagagcggagagccggtaccgagtgcattgaatggttatctggatactatatgtcgtgatacggcagaggaaaagaattttgatgttgtgatgcatgaaaaattcgccgcttatttaaacgagatgagcgaaaaatatgattatattgttattaacagcccaaatgcaggagcaagtgcagatgcttatgcggcttccaggctttgcaacagtagttttgtcgtatgcacaagaagcggtgtggacaatgagatgctgtgtcgcctgaagaatacggcagatgcgcaggaaatcacaattgaaggggttctggtatatgaagggtagtgacgttctctatctgagttgtgcactgctttttgtcccggtgctgatcggcagtttctgggtacacttgttacagcttgagggaacggtaaaccggtttctgcatgcctgggtgctcggctttacgaccatgctggctgtggcacagctgctgctggttccgatggtggcattgcagcgcacattgtacgaagcggttatgctgtggaaaatcttgctggaggtgctctcggtgatttccctgatcttgctctgtggcagggaaatccagaaaagcggaaaacgggatgaccggggaaaacggcagaagatgacagcgtggacggctgtaattggcattgctgcggcggtgttgatcctgttacaggcatatatcccggcgagatatcagcacagtgatgatgatgatgcgaggtttattgcggaggaagtatcggcggtagtacatgggagcatgtaccgcgaggatacgatcacggcagattttatgtactgggataccggggaggtgcgcaaggatctgacctcaccgtggacgatgttcgtggcaatgatggcatacgatggaggaatcgctccggcagtactttcccatgcatatctgccgtttttcctgatccttctgtgctatgcactctatacactgatcgggcagaaactgtttgacggtgactgggaaaagacaggcgtttttctgatcctgctgtcagtgatttacctgtggggatatacatcgacgcatacgctggcatcgatgatcctgcttcggatctggcagggaaaggcagtctgcgccggttttatgatcccgctgtttttctatctgttttatcgtgtgatgaggccggattatgagaaaagatggctgcccctgttttatgtggcagctgtgggagcgtgtctgttgtcgggagtcggaattatcacgacaccgattctgcttggaatctacggttttgtggatttctgctgtcacagggactggaaaaagacacttatgatttttctggcagcagttccgtgtggaatgtatctattgtactatttgaggtaagagaaaatgatgacatacatgttgggtgtctggggagaatttctgaacttcatagggggaagagtgggcgctattcactttgtattgtttgcagcggcatcactctgctgttttttccttggaagggaagaacggaataagctgttctggccatcggtgctggtcggtctgtttttctttaatccgtttttttatcagtatattggcacccggtttttaagtggcatctactggcgactactctggatgctcccctgctctttcgtgattgcctacactctgacgaggattctgttccggtttcggaaaaacgtatggcgcatggtggcactggtgctggcgtgtgtctgtattgcagtgaacggacgcccggtcttatcggcagagacttactcggagagagagaatctttatgaacttccggatgcagtgatgggaatctgcgattatgtgcaggcacatctggagggatggcaggagacaatgattgtcccgaatgaactgctctgtgatatcaggcagtattcttcggccgcatgtcttttatatggaaggaatgccggcggatttatctcgatcatcggcgatcgggagatgcaggtctatgaggagatgtcgaaagagaacccggatgtggaactgattacggacattgcgaaggaaacgaactgcagatacattgtatttaatacgtcatttcatcagataccggaagatttgcgcggctatgggtatgagaaagtcgctgtgatcgacgagaactatgccatgtattgcagaatcagcgaataagcagcagggatatgaggaaggcagtcagacaatatggaaaaaataaaaacgattttacggacaagtgactgggaaaaagtcggcattgcagctttttatggatattttgcgatcaatatcctcatgaaggcatttgcctatgatcatggggatgatatctacaagtttttctttatttttgccatgacattctgggcaatcaaggttgtcacgacaaagtataccatacgtgagactgcatggattgcggtgttgctggggatcggtctgatgctctcggttatcaccaaacagaatacgtggctgttgttgtttatgacgatcatcgccatgaaaaactgtagtttccggcagatgatccagattgctgtctatctgcgcgtgttttgtctgtttgttctggtgctgggctcggcatttggtgtgtttgacatcggatttaagacgacaccggataccaattatgtggagattccggtgtacagttttgccatgaacgaaccgaatacggcatttctggcagtttttttgacaatactgcttttgttatactataattatgaaaaattaaatctctggtggttcatcggaacttcggctgtggcgctgatcttctatgaactcacgttctgccggacaggaatcgcggtatttttctttacctgggcactgatcatttttgagaagattgcaaaggacaggtataaagtaatttttacgctttctgttccggcgggagccatcttcagccttctggtgatgattttttatgacggaggcaactcgtttatgcacctgttaaatcatctggtatcgggaagaagctatattatgagcagctactataaggcacagggtgtttctctgtttccgagggtacaggaactcttttacggagagtattatggactgatcgataatacttatatgtatgtattcctgtattgcggcgggcttgttgcagtattcttctttgtattggtgcagaagacactgatgcgcctttatcgtgagggacattataaagaattggctatgatcacggcatttgcactctatggagtgttagagcagtttgtaatgaacggttttatgaatccgttcattcttctgtgtggaattctgctgtatccggatattctggaccagaacactgcgggcatagagaaatgaggaagatatgaaaaattaccggattttacagatacacaatttttatcagatcccgggcggagaagatgtcgttgtacgcaatgaaaaacgtctgctggaagagcatgggcacaaagtctacacctattaccgttccaacagtgaactgaatgaaaagggaattgctggaaagctgttattgccgtttacagcagtcttttccttgaaaacatatcgtgaggtaaaaaggctgatccgtgagaacaacattgacatcgtacatgtgcacaatacgcttacgatggtcagcccgtcagtgttctatgcggcattccgctgtagggttccggtcgtacagacactgcacaattttcgtatgctctgtccggcgggttcctttttccgggataatgtcatctgcgaggagtgcgtggcacatggaatgcactgcgcgatccgtcacaaatgctaccgcaacagcaagttgcagtcttttgtcagtgcggcgatcttacagattcaccggtttgtggggacataccggaaagtcaattttatctgtttgacggagttcaaccggaaaaagctgctggagtccctggataccagacgcgagattgtaaaggcagaccgcgtctacatcaagccgaactttacctttgcagaagagattgtgccgaatgaagtacaggcagaggaggaatatttcctgtttgccggtcgtgtggaggcactaaagggcattgatattgcagtaaaagcatttgaaaaactgccggataaaaaactctatgtggcgggaaacggaccgatgatggaagagatgcagacttatgtcaaggagcatcatatggacaatgttaaattccttggatatctgcagaaggaggagatgtccgagaaattctatcaggcgaaggcggtcatcatgacatcgcagtgttatgaggcgtttgcgatgaccattgctgaggcgtattcttatggtgttccggtaatcgcgggcagggtcgggaatatggaaggtatggtaaaggatgggattacgggcgtgaagtttacctataattcatcggaggatctggcagagaaggtcagaaaatttgacacgatggatctgtctgtgctcaagaaaaatgcgagatctttttacgccgacaggctgcgcccggaggataattaccagaaactaataaagatctatgaggatatatcaaaatgataaaagctgtatttatcaccaatattccatctccgtatcgtgtggatttttttgcatacttgcaggagcattatccggaatatgagtttcatgttattttttccggtgcaggaatggagaaccggaagtggagtgtggaacttgccgaactgaaaaatgcacattttttaaagtcaaagacgatcatcatccgcaaacgttttgatgaccggtatatatttcttccggtcggcgtggaaaagacactacaggagatccatccggatctcgtgtttgccatggagtataatccgacgatcctgcgagcggtgcactggtgtcagaaaaaaaagattccgtttatcagctggacagacggtacattaaattccgaaaaaaatatcggaaaggtgcagcgtatgtcccgcagttatattataaagcgtgcggcagcgtttgtggcgagcagtacggcatcgagacaggcgcagattgcttatggggcagatgaaaaaaaatgtttcatttcctatctcacggtggatattcagaaatatctgcagaagaaaacggagtatggtggaagagaacttttgtatgtgggcagtctgattcagagaaaaggactggatctgctgtttccggcacttgcacagaccagggaggatatctgccttacgatcgtaggtgaagggcaggagaaggaagcactgatggaacaggcaaaaaagcttgggatcacatcccgcatccgctttctgggatatgttgagggagaaccgctgcgggagctttaccataatgcagatgtatttatcctgccgaccagagaagattgctttggactggtgatcctggaagcaatgtgtgcgtctcttcctgtaatctcatcaaaatatgcggacggtgcgtttgacctggtacaggaaggagaaaacggctgtattatagacccggaagacacggctgcttttgcagcgaagattgatcagatttttgcggatgaaaagcggcttgcagagatgggacagaaaagctatgagttcgcgcacgcattttctttccaggaagtggcaaagggatgtattgatgcactgcattatgtaacaggaaaggcatgagcatgaagaagattttatttaacggacttggtaaccgcggatggattggtggtctgtactatctgaaaaatattatattcagctgtctgcagagtgaagagatcacaaagaaataccggattgtggtactgattgatccggaacatgcggatatttttacctgttttggaaaccgaattgatctgcgcatctatgacgggacgaacaaggtgaagctggcactttatgagatgaacctgatctggctgcacggcgtgaagtattgctacgcactggaactcaaccgcatcggcagtctgtttgcttccagagggatcttctggataccggatttccagcataagacgctgccggagttttttaagccggaggagctggcaagaaaagatgtcacggaccgcagaatgacggaactttccaatccgctcgtgcttagcagtgaggatgcaaagaatgatctggagcggttttatccggaacatcagtgtaaggtgcaggtcatacattttgtttcctacattgagccggaactgcgtgccatcacgccaaagctggagcacgaggtagcggaaaaattcgggctgcagagaaaatatatctatctgccgaaccagttctggaaacacaaaaatcatgtggtggcggtaaaagcgattgaactgttaaaaaagcaggggcttctggcagattatgattttgtatttacgggaaatcttaaggattaccgcaacccggaatatatcgatgaattaaagaagatcatggaggcacagccggtggcaggcagtatcaaactgcttggttttgtggagcgcacggagcagctttgcattatgaaaaatgctgcctttatcgtgcagccatctttatgtgagggatggggaacggtactggaagatgccaaggtactggataaggcagtgctgctgtcggatattccggtgcacagggagcagaaaaatgaaaagtgcgttttgtttgatccgcacgacccgaaggcactggcacagcttcttgtcgagacggcagaaaaggcagacatgccggagcatactgcatattttgcaggtgacatggagaagggaattgcaaacatgtaccgtgaagcggaagcatacgcaaggggactggaaaatatctttgtgtagaccaaagggctgaccggcatgaaatccccggaatggagataacgatgaaaaaaatggtgataaccggtgtcaacggatttattgggagacacgcaaaggaatattttgaaaaagaatatgagattacgggactggatcttgcagcaaattacagtggagagagagaaccggacgataccatgacctattatcagtgcaatatgtcacaggaatctgcagagatggcggcgatttttaccggtgtgcagccggatgtgatcctgcactgcgcgggaagtgccaatgtgggagcttcggttgtcaatccaatggcagatctggatggaaatctgcacagcctttatcagctgctgcttgccttgaaatcttttgagaagagaccggagattatattcctttccagtgccggtgtgtatggcaatcccagacagcttccggtgagggagtccgatgtagctgcaccgatgtcaccgtatggactgcacaagcatatgggagaggaattgtgtgagtattataaccgcattcatggttatcacatccgcagtatccgtattttttctgcttatggaaacggactgcgcaagcagctgttgtgggacatatatcagaagtatcagaatactgggagaattgaactgtttggaacgggggaggagacgagagattttattcatgtctcggatatcatgcgtgcaattgatctgatcttatcttacgatggaccggaggcggtcatcaatgtggcgaacggcgaagaagtatcgatccgggaactggcagagatttatgcagaaaagctgggcgcgccccaaaatatcgtatcttttaatggggcagtaaaagaaggtgatccgagaaactggagagcagatatttccctgttaagaaagcttggatatgagaagcagatggaactttccgatggaattgcggcttatgtggactgggcgaaggcgcaggattaggagcggtggatatgagtgagagaatgatggcgccggtcgtgttgtttacttataaccggccggagcatacgaaacatacgatcgaagcactggctgccaatgagctggcggagaagacagaactgtttgtattttccgatgcggcgaaaaaggaggcagatgcagcaaaagtacaggagatccgggagtatgtcggtacggtgcagggatttgcaaatgtatcgttgattgtgcggaaagagaactacgggcttgcccgaaacgtgatagagggtgtgacggagatcgtcaaccgctatggcagggtgatcgtcctggaggatgaccttgtgacaaaccgttatttcctgcgttttatgaacgatggactggatcgttatgagaaggaaaaacaggtgaccggagtcaccgggttttcctttttggatgatagaacagactatgacagcgaatcctatctctgcggtctgacagggacgagctggtcatgggcgacctgggcagacaggtggagttactttgatgcggaggcacttggctgggagaagttaaagacagatacggcataccgaagacggtttaattatgataatacctataatttttatcaacttttaaagatgcagaagcaggatgagaagaccaattcctgggcgatccgctggtattacagcacttttttactggacggactgatccttgctccgacaaaatcattggtcgggaatgacggctgggacggcagtggcgtacactgtggcggggaggctccgacagcagtgcatgccttaaagacggatcgggtcatcacacagttcccggatgtgattgcagagatgccacagatccgtaagcggctcaaaaaagaactgataaagatctcagagccgagccgggtaaagaggatctaccatgccgtattccggaaaaactatattggtcaggcatagagataaagaagaaaatgttggagacagagcttatgagagtattggcaatttttacctgttacaaccggagagaactcacaaagcagagcatggagctgctcgggcagaacaaaaatgtcacctttgattatgtgattgtcaatgacggcagcacggacggcacggatgagatgctggcggcgatgccgtatgagatcgatttaatcaacggcgacggcggactgttctggaaccgcggcatgtatgaggcgatcgagcacgccaaaaaggtgcatcccgattacgagtattatatgctgatgaacgacgacacgaagtttgtgccgggcattttcgacgagatgctcccgttgtttgcaccggataaggtcatggtcggggcgatgtgcggggatgacggcaggatgagctacggcggcatcaagtacgtcaagggcatcaagtacaaaaaatacggcccggaggcgcaggacatctgttttgacacgtttaacgcgaactgcgcgatcattccgcatgacattttcatgaaagtgtcgattgacccgttttatcagcacagtatcggtgattttgattacggactcgccatcagccggatgggatatgagatccgtattttcccgaagttcatcgggcagtgcaacgacggcagcctgaagggaacctggcaggacgagtcgctgccaaagatgcagcgcattaagctcaaggagagcagaaagggactgccgtttcgggactggttccatttcctgcacaagtattttggactcggaacggcaatcgtgcgttccatcaccccgtatgtccgcattatccttggcacgaagaccagatactcgggcgcataagaattcagggagacagtgccgatgagaacgatttgctatgtcatcttaaattacaaaacatacgaggaagccgccgcatgtgcagagtcgatcctttcgacgcagacctggaaaaacatgcatattgtcatcgtggacaacggttccggaaacgggagcgaggagtggcttgcggaacattttatcgatgaaaaacgggtgcgcgtgatcgcgtcgggagagaatctcggatttgccagagggaacaatctcggcatccgctatgcgagagagcactatgatccggatctgatcgtcgctgcaaacagtgacatcctgtttgaacagccggatttttgtgagcgcctgtttgagatctacgacagaaagccgtatgcgatactgggcgcggatgttgtggacgcgacccgcacgcagcactttaacccggtggcggagaagcgcagctataccttgaactatatgcgaaagcagatcttatcatcctggatccgggcgatgagctaccggatgtccaagctgttcttggggaagaagaacggaggcgatctgtcgcgtggcaccggagcgacccgcgaggtggacggcgaggcggtagcggcggacagcagagtcggcgaggagcgcgagggagtgctgctccacggatgctgccttgtgttttcaagagatttcttcaaagtgtatgatggcttctgggaaggcacctttttgtatgcggaggaggagattctctactatctggcggcaaagagcggactgcggatgctgtattcgccggaggtcacctgcattcataaagaggctgtgacgacaaggaagctgtacagcgatgtatgcgatgccaagattttttactatacacagatcaccaaatcgtaccgggcgtttctcggtctgatgaaagaatcgaaataggacagctatgagtgaggagaacaaggtaatcaaggccggcatcggctatacaatcggaaattatctgctgaagggactgagctttctaacagttcctctgttctcgcgtcttcttgatacctcggattatggtatttttaatacgtatctcgcttatcagggcattatgttcctgctggtggggattgcactgcataccagtttgaaaaatgcgaaataccggtacaaagaagaatttgaccggtataactccaactgtattctggtgatgctggtcagtctggctgtctggctttttcttgccaatctcacatatcctctgtatgcgggactgaccggtttttccagattcatcatcaatctgctgctgtttgacagttttggtacggcactgatccagttttttaatgtgtatgtcgggctggattaccgttatgattcgtttttaaagatctccgcattcaatgcactggggaacctgggaatgtccgtgatcctgattctgggatttttcaaggatgaccgtgcaaccggacgtatcatcggaaatgcattgccagtgatggtgatcgcggttgtgctgatctggtatttctggaaaaaaagaagacccaaatggaaccgggagcaggtcacttatgcagtaacatacagtctaccgttgatcccacatggcatttcacaggtgatcttatcccaatttgatcggatcatgataaagagtatgatcggaagtgcagaggcaggaatctacagttttgggtacaatattttttcaatcatcaatgtcacggcaaattcgctggacaatgtctggggaccgtggttttacgagcagatgcagcagaaaaagtatgaggagatccgaagacagagcagcaaatacgcatttggaatgctattgttttctgtaatggttatgctcggcacgccggaacttgtgatgctgcttggtgcaaaggcgtattgggatgcaaaatatacggtcataccgattgtcgtaggcggctattttatgttcctttatacactgccgtcaagtgtggagtattatcatgaaaagacgaaatatattgccatcggtaccgcgtgtgcggcggggatcaatatcctgctgaatctgtggtttatttcgcgttttggctatgttgcagccgcatacaccacacttgcgacctatgtgctgtattttgtatttcactatttcattgccacgcgggtacagggcttttgtatttttgatacgaaaaagatgatcctgtacggaatttccgccgtggcagccggggcactctccctgcttctaatggaacatggatggatccggtggggattactgcttttatgtgcggcgtggacatgcctatggctggaaaaacaatttcagattacggagaagatcagaaaacgattttggaaaaaatgacaggagaaagagtatgaagcggatagaaatgtcaatcgaggaaatacatgaggtaacacttgccatattgaagaaaatcgatgcgattgcggaagagatcggaatccggtattttatggcatatggatcgctgattggcgttgtacgtcacagggggtttattccgtgggatgatgatttggatatgatgatgattcgggaagattatgaaaaatttcttgcatactttgaagagcacgaacaggaacttgtgccatacaagatttttaacaaccgtaacaatgctggttatccacatatgattacccgggtgtgcaatgtagaatacccgatcgaagtggataatgagatctcgtgcggaatgggcgttttcgtggatatctatccaatcgatccgatgggaagcgacgaaaaagaatgggagcgagtaatgcactacagacagcagttgattgcgggtagttactatgcttcgcggattcggtttgaaaagccgggaaaaagttatcgttgcctggatcgatatctgctttaccgctatgcaaaaaaaaggggactggcttatttccttaacaaactggaatcctataaaaacagataccggtgggaggacagccggtatgccggatgtattgtgtgggaaccggaactgtttgaaaaagagtattttgaagaggtaaccagactgccgttctgcgatatgcaggtcatggtaccaaaggagtatgaccgtatgcttacgacatcatatggggattatatgcagcttccaccgaaggaagcacaaaaaccgcagcataactataccgcgtaccgcgtagaagcgtaaggaggagaaggatgcaggcaattattttagcagcaggaatgggaaagcggctcaaggagctgacacaggataatacaaaatgtatggtcaaagtggacgggatttctctgatcgagcgggctctcggacagctggaccggttaggactttctaagatcgtgatcgtggtgggctatgaagggcagaaactgatcgattatatcggtacacttgcggttcagacaccggtcgtgtatatcaacaatgagatctatgataagacgaacaatatctattctctggctcttgcaaaagagtatctgctaaaagaagatactctgcttctggaatcggatattatttttgaggaagccgttctgcgtgcgctggtcgatgatccaagagacacgctggcactggtggataagtatgaacgctggatggatggtacggtcgtgaaactggatgaagaagatcgcattatagaatttgtgcctggaaagaaatttaaattcagcgaacaggactcctactataagacagtcaatctgtataagtttagcagggaatttgcaagaaaccgttatgtgccattcctcgaagcataccagaaggcattgggaaataatgaatattatgaacaggttttgagtgtgatctcgattctggatgagccggtcataaaagcaaagcggctgcatggagaacggtggtatgagattgatgatgtgcaggatctggatattgcaacgacattgtttgcagagagtgaagatgagcgtgtctctttgctgggggcaaggtatggcggctactggagatatccgaaacttctggatttctgctatctggttaacccgtattttccgccacagaaactgaaagatgaactgcaggcgaattttgatgtacttctgacccagtatccatccggcatgcgtgtgaatgcgctgttggcggcaaaaaattttgctgtccgtccggaacacatcgtggtgggcaacggtgcggcagagctgatcaaagaggtaatggagcagatcggaggaaactgcggatttatccgtccgacttttgaggaatatccaaatcgttttcctacggagaggtcggttatctttgtgccgcagacggaagatttttcctatacggcggaggatgtgatcgcttactttacggcacacccgatctcctgtctggtcatgatcaacccggataatccgaccggaaattatctggatcacggggagcagatgaaactactgacgtggtgtgacagggagcagatcacgctgatctgggatgaatctttttcagattttgcggatgaaccggataatcagatgctcacagaggaactgctggaacagtatccaaagcttatcgtggtaaagagtatttcaaagtcctacggtgtaccgggactgcgtctgggtgtacttgcttccggaaatgagacgctgatcgcggatctgaaaaaacgggcagtgatctggaacatcaattcttttgccgagtattacatgcagattgcggagaaatataaaaaagattatgtggcggccatggagaagttcagagaggaacgtgcctggctggctggcgaactggaacagattgcgcatatgcgggtgtatccgacccaggcaaattatttcatggtcgagcttctggatggcagacgttccggcgatgtggtgcgtgagctgttagtccatgaacagatcctgttaaaggatcttaccggaaagataaagtgtggcgatagacagttccttcggatcgcgatcagaaaccgtgtggagaatgagagaatggtgagggcactggaaaacattttaaaataaagatgtttggccggtgtggagaataggtgaaaaatgattcaaagtattatatttattctggcaatgacttttataccatactttgttggatgcggatgtatattattagatcgcaaaacaggcgacatagatgtgcttgaaaaatggaattttggtatggtgctgatgcatgcgatatttgaaattgtagttctagctggcacctttacaaaaatgacattgaaaaacgttacagtgttctattttgcgattttgtccgcggcaatcatgatagtggggctgattgggaacagaacgaaaaaaaaagtgttttctgtagggaagattccttctttttctaaaaaagagatggcgttgcttctgatagtgttagtggggattctgtaccagattttgtttgtatgtctgggactacagagtgatgccgatgatgcatactatgtggggatggcgatgacttcttttcagacggataccatatcagtatatcatccttatctggggacacctgtaaaattaaagaccatggcaaactatgtcctgtcaccctatccgattttttgggctatgtggtcaaaagtgttaaaaattcatccggcaatcttgatgagaagtattcttccggctgtaaatatcgcatggtcatatgttgtatatagattgttagcgaaaaaaattttccttaccgaaagaaaaagaattattttcctgctgattgtagttctggcaaatctttttggcgcatattcggatcgtacaagcgccgtgttcttgcttcaacgtgtatggcagggaaaaggagcactggcggcgattttgattcctatgttgtggtatctattgatcagattgcgcaaagaaggggaaaacacatatgtttatgtagaattatttgtgacaattttagcagcatgtcttacatcctccatggctctttttctctgtcctgttttaatgggagcgtttggactggaatatttgatcagtgagcgaagatggagcgtggtaggcagactgatcttatgcacattgccatgcatagtactggcgattgcagaagtaattttattatatgtgctttagagaaggtgatgagtatgatacagcagggaatcgcatacatggcagaaatttttgaaatgtattttcaaaatgttggatatataatattggtgtgtgccgttattctattgttactgacacggtatagaaaaaaagaggtgacgcatttattgttcgtctgtgggattattctgattttatttttaaaccctgttgtgatttatctggtctgttcgttaaaaggagcggttacaggacgttatgtcagaatattctggcttttcccatttactattggaattgcatatgtgggtgcacagctgttggataaacgcaaattgtgggtgagagcaattatgattgcggcgattgtagtgatactctggggaacaggtggaccggttctgaaaaagtatatagctccttctaattattataaaatagattcggagattatcgagattgcagataagatcgagacatatgaggatgcaccatatgcgctggcaacagtttatgtaagcacaaatataagacagtatgatgcgaatataaggcttgtttttggacgggaaaatataaatcctgaggttcaggatttatatgatatgctatacagcacagcagcaggatatttttcctatgatgagctatattacattggtatacgttctgcagaaataggagtgaatacgattgtacttgcaaaacaccaggtgcaatgtactgcattggaaacacttgggtatgaacgtgtggatgagacagaggaatattacatttttgataagagacaaatgtaaaacgtgcaaagttgcgacagcatggacattatgatataatgaactttaacgagtttatattagaagttcctgtggaacttcagatgcgcagaaggcagcgcagtcagtgcacagaaacaaataacagatgttactcatcaatgaaaaaggaaataatggaatgaatctgaaggaacaatataagcatttactgaattatggcgcaaaccttatcacacttctggtggaaggcttgtgttttggctacatctggtacattgtttacgaggagcagtttggcttctggcgccgtggaaactgggcggttgtcggactgtatgtgctggtaatcttcttttttacgaaggtatttggtgggtacaatatcggctatatgcggatgacggatattgcattgtctcatattttatccattttactgagcgggatcgtcggatatctggaactctgcctgatctgccgtgattatgtagagccggcacctatgcttgttgtcatggcagttgagacaggcttcattctgccgtggatttacatcataagaaaactttatactaagctgtatccgccgcggcagatgctcgtgatctatgggcattatgcgccggacgagctgatcttgaagatcaatacgcgccgcgacaagtacaatatctgcggatcggtcagctacgagatcggtcatgagaagctttacccgatgatccgcaaatacaatgcggtggtgctctgcgatctgccggcacaggcgagaaaccagatcatgaagttctgttaccaggagtcgatccggacatatgtgacaccgaagatctcagacatcattttccgcggggcggacgacatccatctgtttgacacgccgctgctgttatcgcgcaatcagggattgtcgattgatcagcgcatcatcaagaggacctgtgatattgtgctgtcactgatcggtattgtgatcgcatcgccgttcatgttaatcattgcgttggcggttaagctgtatgatggcggtccagttctgtataagcaggaacggctgacccgtgatgggagaccgtttatgatctataagttccgcagcatgagtatggattccgagaagagcggcgccagacttgcggcaaagggagataagcgtgtgaccccggtgggaagggtgatccgcaacatccattttgatgagctgccgcagctgtttaatatcttaaagggcgatatgtcgatggtgggaccaagaccggagcgtcaagtgatcgcggatcagtatgctgaggagattccggagtttgtgttgcgcaccaaggtgaaagcgggactgaccggatacgcgcaggtatatggaaagtataatacgacaccgtacgataaattaaaattcgatatcacttatattgaaaattattctctgtggctcgatgttaagatcatgctgttgacgtttaagattctgtttcagaaagagaatacagaaggcgtggatgagacacagaagacggccttaaaaggataagctggaacagggagcagggaatatggcgttttcagtattaatgtcagtatataaaaaggaaagaccggaatatttgcgtgaggcagtgaaaagtgtatttgcgcagtcgcttgtcccggatgaagtggtgttgatggaggacggaccgctgacggaggaactctatcagatgatcgcaacgcttgaaaaacggtatcccgcgctcagggtttgtccactcagagaaaatgtacagcttggacgcgcacttgcaaagggcgtggaaatgtgcacaaatgaattgatcgcaagaatggatacggatgatcttgccatgccggatcgattcctgcatcagtatgtctatatggaagcacacccatctgtgatggcctgcggcggctggatgcaggagttcaatgatacaggtacttatcacaggcagaagcagatgccgcagcacaatgacgagataagaaagtatggaaagtaccgcaatccggtgaatcatatgactgtcatgtttcgcaagagcgcagtgcttcgggcaggaaattatcgtcacgttccgctactcgaggattatgatctctggacgcgcatgatggtacagggaatggagttttataatcttccggaggtgctggtttgcatgcgcaacaacgatggcgtgtatgaccggcgtggcggttttaggtatttccgccggtatgcggcattccgaaagagccagaagcagatgcactggctgaatggaagggaatatgtcgtcgcgttgattcttacgatggggatgacattgcagccggaacgaatgcggaagtttgtatatcagaaaatacttcggaaataagagtgagggttatggagaagatattaagtattgtcattccggcatataatgtcgaaaaatatttggaaaagtgtctggcttcttttgaaatacaagcgattttagacagaatagaagtattggtaatcaacgatggttccaaggatcatacggcagagattgcacagcggtattgtgaaaagtatccagagacatattttctttataataaggaaaacggtggtcatggatcaggtatcaattatggaattcgttatgccacaggaaaatattttaaagtggtggacggggacgactggctgaatacagaagagctggaagcgtttgtgaagctgttggaggagacagatacagatattgtggcggcgggttttttgtgtattcaggatgagacggacaccgtcctgcaggagaagcattgtacgccttgcagagagcagtatggacacattgtggatcttacaaagggtgaggtggtggatgtgataaaaatgcatgcactgaccatccggtcggcgatattgaaacagaatcacatccagattgacgagcattgttattatgtggactgtgaatatattacttacccgattccgtttgcaagaacagtttatttttatccaaagttcctgtacatgtatcgacttggcagaaatggacagagtatggatatccgaagtatgcagaagaatcgtatgcagcatcagaaggttttggacagcctgttgaagttttatgcgggactgcatggactgtctgacggaagtatgagatatattgagcgctgtattgcacaggttgtggaaaatcagtttcagatttatatcagtatggggtgtgaatctggaattaagaaagaattaagaaactgggatcaagggttgaaaaagaggtatcccaggatttacagtgccacaaggaaaaagagcattaccatgctccggagaacgaattatacgatgctgcccattggaacaattgtatacaaaattgtacgatctagaagatgacagtgacttgacaaatatacatttttccaatattgtaagatagtataggtttttgcagattactttagaagtgagtagaatgtcgtaagtgaaaggagatatataatgaaagttgttttattagcaggagggtttggaacaagaatctcagaagaatcacatttaaagccgaagccaatgatagaaattggcggacagccgattctctggcatattatgaaggagtactcatcgtacggattcaatgagtttgtgatctgtgcagggtacaagcagcaggttatcaaggagtattttgcaaattactatctgcatcgttcggatattacatttgactttacggcgcagaacgagatggtggtacacaataatgtggcggagccgtggaaagtatctattgttgacaccggactcaatacaatgacaggtggtcgaattaagcgtgtgcgcgattatattggcaatgatacatttatgcttacttatggagacggcgtctgcgacatcaatatcaaggagttatatgatttccacaagaagagtggaaaactggcgactatgacagccattcagccgggagggcgtttcggaacacttgatatcgatgaaagcaatacgatcgagcgtttctctgaaaagagaaaagaagatggcggatggattaatggcggctatatggtaattgaacctcaggtcattgattatattgatggggatcagactgtttttgaaagagagccgctggagcgtctggcagcagaggggcagttacaggcatataagcatgatggtttctggcagtgcatggatacgctgagagataagaatttactggaagagttattggagcagaataaagcaccgtggaaaatatgggagaactaagatggatttaagtttttataaaggaaaaacagttttagtaacaggacatacgggatttaaaggaacttggatgtgcaaggtacttatgatgcggggagccaatgtgatcggatatgcattggaagcaccgacacagccaagtctgttcgatatgacgcatatggagaaggggatgacgtcggtaataggtgatattcgtgatctggcacatcttaatcaggtgtttgatgaatatcagccggaaatcgtaatccatatggcagcacagccgatcgtaagagaaagctatgcaaatccggtatatacgtatgaagcaaatgttatgggaactgtaaatattatggaggcagtccgcttacatgaatgtgtaaagtcatttgtcaacgttacaacggacaaggtatataaaaataatgaatgggagtggggatatcgcgagaatgatgtcctcgatggatatgatccgtactctaattcaaaatcctgttcggagctggttacaagttcttacaagaaatctttctttggagacagaactgtcgcaatttcgacgtgtcgtgcgggtaatgtaatcggaggaggtgattttgcaaaggatagaattattccggattgtgtgagagcgcaggaagccggaaaggaaattatcgtccgtaatccgtattcaaccagaccgtaccagcatgtgctggagccggtatgcacgtatttgaagctggcagaacttcaatatctggataaagacagatatgaaggcagctacaatgttggaccggatgactgcgattgcgtaaccacaggagaactggtagatctgttttgcaaatattggggaccagaggctacatggaaagatgtatcagaagcgaatgcaccgcatgaggccggatttttgaaattggattgctccagaattaagagagtgatgcagtggaaaccgaagtggcatattcaggatgcagttgcaaatagtgtacagtggagcaaggtctatctggcgaagggtgatctggttgccgagatggaaaaagagattaccgattatttgaaatagattttaggaggcatttcatgacaaaggttattgtatcaggtgcaaatggatttgtaggtggtgctcttaccagagagttgattgcaaatggaataaaagtagttgcattagatatggaagggcacaataataatctgcctgagagtgatctggttgagttttacccgttttcgcttgacaatgcagaggagctgcaggagagattggcagaccgggattttgatacgttttatcattttgcatgggctggatcggcaggaccggccagagcggatacggcgcttcagttaaaaaatgcacagtggacagtagattgtctgcgccttgcaaagaagctgggatgtacaaggtttgtgaatgccggaagcattatggaacttgagacaatcaaggcggtatttaatccgggaaataagccgggattgggctatatttatggaagcggaaaactggtggcacatacaatgtgcaagtctgtggcggctgatataggtattgatctggtgtgggcaatgattactaacgcatatggtgtaggcgagagaagtccaagaatggtcaatactacgatccagaaatgtattcggggagaagcacctcagtttacagccggaacgcagaattatgactttgtctatattgatgatgtggcaagagcatttcggctcattggtgaaaatggaaagccgttcaatgaatatctgatcggttcatccaatgcaaaaccgctaaaagaatttttgctggaaatgaaagctgcaattgctccggaacttgattttatatttggagatattccgtttacaggcgtgaatcagccgttagaggactttgactgttctaagacagagcaggataccggttttagagcagagatcagctttggagaagggtgtcgccggacacgtgactggtggcttgagatcgcgaaggaggagagtaaataaatgatccagaagtttgaatttgaagagacagagatcaagggacttatcaaagtcactccgttcaatgcagatgatatcagaggctgctttacaaaggactattccaaggaagtatttgaggcaaacgggatacaccatgatcttgcagaggtgttttatacaacctcccataagggagtaatccgggcattacattttcagcgcgaaaaacagcagccaaagctggttcgctgcatatatggtcacgtttatgacgtggttgttgaccttagaaaggatagccccacatttaaaaaatggcttggctttgatctgatcggggagcagcataatgagatactggtaccggcaggatgcgcacatggataccttgtgttggaaaagtcgatcgtaagctacaaatgtggagaaaagttttacggcgaatatgacgatggcattatgtggaatgatccggacattgctgtagagtggccattggaaaaagtgggtggattaggaaatgtaattttggcagataaagacaaaaatctgcagacatttgaacagttcatgaatacgtatggaggattctaaatagagaaagattaccgcaatcaatcatggaatggattattgcggtaattttgttgtgagaagatggaagaaaaattgtatccaatcaggcagcacgaagttgcgattacaatggcatgcagcgacagctataagaatataatgggcgttttgctgcaatcaatcattacaaatgcagatgcacaagagaattatgatattgtaattttggaatacggaatcagtaaaagcgaccagagcagaatcagccggttctatcagcgtgaaaatatttcggtaagattttatagtgtcagagagcagatagagggcaaggatctgtatgttcacggatatttatctgtgatgacctatgccagattgctgattccgcaaatatttgaaaattttgaacgtgtagtgtatctggattgtgatatggtatgcaatagtgatattgcacagttgtttcatgcagatatgcaggataagccccttggagccgtggcagatacggtattaaatatggaagcctggcataatccaaacagcgaggagacaaaacaatatctgaaagagaccgttggtattacaaccgaggggcgttactttaacggtggagtgattctgtttgatatagacaggttacgggaagatggagaaaaactgttggcgtgcgcccgggaaaggcagtggcgctgggcagatcaggatgtattgaatcatatatataaggagcgcgtgttttactttgacctacagtggaatgtgattgtgatatcaaatctaaaacaacgcaagcggtatctgagcgacagtaagttatacccggattatgaaagggcattggaagaaccatgtattattcattatgccggagagatgctaccctgttatcgaagaaatgtaccactggggtacaaatttttgaaatatgcagaaggttctctttatgcagagcagtttcagagaaaaaagtttaaacgatcagtcgggaaaagggttctgctggatcagatcgcacgtgttattccatatgacagtaagctaagaaaacagattaagaaaataagtgtaggaaggtaagagatggagttattaataagacgaattaacgggttatatgcatataaagaccttgtaaagcagttggttacaaaagatatcaaactgaaatatcgcagaagttttctcggatatttctggagcatactgaatccattgttgattatggcggttatggtagttgtcttttcacagattttccggtttgaaatagatcattatccggtttatctgatcatcgggcagacgctgtttaactttatgagtgaatccacgggacaggcgatttattccatactggggaatgcgccattgctaaaaaaggtgtatgtaccaaaatatatttttacgctctccaaggtgacaagttcgctggtgaatcttttgttctctcttggagcaatgttgattgtttttatagcttcaagaatacagttttcaatttatatgctttttattcctgttatattgattgaattatatgtattctgcctaggacttggaatgtttctggcacaggctgctgtatttttcagggatatccagtatatctataatgtgtttatcacggtatggatgtatcttacaccgattttttatccgatatcaattctgccggattatgttaaaaatgtaattgtgaacataaacccgctttatttttatattgatcagtttagaacagtagtgctggaacagcagctcccaatgatgcacagtgtggcaggcggctgtattgcagcaatcattgcattaattttaggaatctggtcatttttgaagacgcaggacaaatttattctgtatatttagtggaggaagtatggatagtgaatatattatcgaggtaaatgatgctacagtcaggtttaatatggcatcagagaaaattgataatcttaaggaatacgtcattaaatttattaagagagaattgatgttccaggagtttttggcgcttaaggatattaatctgaaaattaaacccggagaggcctggggattggttggaacaaacggttctggaaagtcaacattactgaagctcatcagcggtattttgaaaccatataagggagaagtgattatccgtggttccatagcgcctctgattgaattgggagctggatttgatgcagagcttacagcaagagaaaacgtattcctcaacggtacgttgctgggacattcagaagctttcatgaaggaacatttcaatgaaattattgatttcgcagagttgtgggattttctggatatgccgattaaaaattattcatccggtatggcagcacgtctaggatttgcagttgcgacgatgacgagaccggatattttgattgtagatgaagtccttgcagtaggtgactatgagtttcaggaaaaatgtaaaatgcgaatgaaaagtatgctggaacaaggaactacgttactctatgtctcccatacaatgggatcggttacttcattgtgtgatcatgcaatttggattgataagggaaaagcggtcatgcagggggatgtcaacacagtatgtaaagcatatatgaataaataggagaacatgaagatgtcagagaacaaggtagtaatagcaggtatcgatgaaggcaaggatttttatcaggttcagaataatgaatttgtgtatgagaatgcaaaaaaggataagacagtataccaggtcttgaaagaggatctgtatcgtgagattggcacacagcttgccatcaaaccggatggcgattatataggaatgatgcagtatcggaggttttttacccaacaggcagaatatgataagccatatattggagaaacttacttaaatgacaaaacggctagaaaatatgggctcaacactttttccatttcagatgtaatgaaaagcgcacagattatatatccagaaatggtggttaccagagcatatgatgcaagaaatgtgcgtgagtattttgcaaaatttgataaaaagcatgatgcggaacattttgttgtgtttgagaatgcactgaaagagaaatatccagaatactccagtgagtttgaaagttatatgaaatccggaaaaatggttttgtgtaatatgtttcttatgaaacgggagttgtttgtgacatataataagatggtagaaagtgtattggcagtattggatgaaaagcttgatatgcggtatgcatcttatgagcagacaaaggagtacagtatgtttactgcggtcatgctggcgacattctgcagataccaggaaaaacagggagtgaccgttagagaattacctgtagttgagtttgaagatgtaactgtgaagacagaactgaagccggcatttgagcacaataacgtagcgatggtacttgcatccagtgatttttatacgatttacctgtcagcaatgcttgaatcgattgtggaaaatgcttctgatgaaaataattatgatattaatgttttggaaagcggcattagaccagataataaagaagcattaaagctgattgccgaagggcatgagaatgtatcgatacgtttctacaatgtaaaagaaaaaatggcaaatattcatctgaaggcgacaggccatatcagtgtagaaacctactataggttgctgattcctgagatttttatcaattatgataaagtgctgtttttggacagtgatatgacggtacatgcggatgtggcagaactgtttcacatggatgtgaccgggtatatggtggcagcagcacatgatcaatgctgcgcagcatttttaaatggaagtgataagtcgtttgcgaaatattgtcgtgaatcactaaaattgaaaaatgtacatgattattttcaggcaggcgttatgctgttgaatctgacaagatttcgtgaaaaatatacacagaaagaaatctttgagattgcaacaaaacgtcagtatcgctatgtagaccaggatatcatgaacgtgttatgtcagggtgaggtaaagcatctggatcttgagtgggattgtttcccggattttggaccatatgaatatgaatttatgccatactatttgcagaaacagtatgcggtagcaagaaagaatccaaagatctgccatcatacaggcccgaataaaccatggagtgagttgtttgcagataccatgcagacggagcatttttggagaagagcgagaaagtcgccgttgtatgagcagattctgttcagaacaatgatgacagccagtggggcgttttggtcaggtgagatcgtgggaaagaagaagtccacaaagataaaaaataagattaaatacggatttattgtgccggcggccaatggaatgtttccgcgtggaacaaagcgtagaaagagcgcaattaaattttattatggcattagacgaaaagagattccgacatgggagctggatgactaaaaggtgatgatattatggggagaagaagagtgtttttcaaaagaggaaagaaaaagcaggatactgtgcaggaattaaagccggtatataagttatctggacaaaataacaaaatttttattatagaaaacggcacggagagagaaattacatatagtgaaaaagttgcaggtatcgagattaaaatacagggaaataataaccgggtgtatttggaacttccgataaaagcggtgggaagtacgattactatcgataacagtaatgcagaggtccggattggaagcactttcctattgaataatgttagaattatatgcaatgatggaaatgagcagcgggtttggatcggagcaggaactaccatgcacaatgtggggatactggcgacggaaaatgcggatatcagaatcggagcgggatgtatgttttctgcaagagtatatatctacgggtctgacggacatgcgatgtttgatgtgaataccggagaatgtattaacggaagaaaacatgcgactgtgatcggtgagagatgctggatttcatcagattccatcattttaaagaatgctgtaattccggacaacagtattgtggcggccgcaagtgtcgtgacgggtaattttgagggagagtcgaatgtctgtctgggaggaaatccggcaaagatcataaggcggaatgtggactggtcgtatgagagtccatcggaacgtttcgcaaggatggcctgtgaggagaaaaaattgacattgagttcggaagagttagaatggagtgttggacaggttggaagattaagcgcatatttaaatgaatgcaggattgccaattcgcaggtggaatggagaagcgaagatcggagcatatgtaaggtaagtgcagcaggagaggtttgtggaaccggcaagggagagaccagtattgttgcagcgtatgcaggtgcgcaggcgatatgtaaagtggaagtgcgttaatgcaatggaacggcaacagatatgttgctgtaacatgtaataagaatgaggatcggaaaatcaatgataaaaaatgttgtagaagataaaaaatgtacaggatgttattgttgtaaggatgcatgtccggccggagcaatagagttatctgagaatgaggatggatttcgggaagccggtgtaaatgataccatatgtattcaatgcgggaagtgtttagaagtttgccctgtcgcccatgatgagaatcgaaaagcatatgacgtttcgtcatatgcttttcgagcatgcgatgaagttcggaaaacagcttcatcaggcggcgtggttccggtggcggcatctgttatcctgcagaaacagggagttgtctgtggagtacagcttacacccgatctgaaagcacagtacatagttatagatcaagtcgaagatatagcaaaaataaacgggtcaaagtatatacaggcagatgcgaccggaatttaccgtaagataaaaacgcttttactggaaggaaagacggtcttatttacaggattgccatgtcagaccgcgggattatataactacctgaaaggatgtgaccagagcagattatatacaatagatatgctgtgtcatggtacaccttcagataaagtatttcgggaatggctttctggtgtatcggaaggaaggcatgccaaatatattaattttcgtgtaaaagacggtgactggaattgtaataccgtgtgtattgaatatgaggacggttctgcttaccgggcagatgttaccgatgattggtttgaaaaactatttcattataatatgtccttaagaaaatcctgttatcattgtaaatttgcggagtttccgcgcaggggagatctgtctacgggagattttcatggaatagaagattgccaggatattgaggatgatcataaaggaaccagcgttatattcgtaaatagtgataaagggcagatgcttttgaatgagatgaaaaaagagaatgtctggatgaaagagatttcggtggaggattccaaaaagaaccggatttgtgcagatatagaagaacatccatacagagatcgtttttttcgtttactcagagaagagaaatatgactttgcgaaccttgcgaaacgtgtactggaacataaattcgatataggaatcgtgggaattccaacagtagaaaaccatggttcaaacttgtcctattatggactttaccggacattgcagcatatgggatatgatgtatttatgatggaacgaccaaaatcagcctggtgggctccgcatgaaacaccggttatattcagggaaaatccgtatgacagcggagatctgtgtgaattgtttgagagcagactgcaactgcagaaggcgaatgactacgcggatacatttattcttggctcggatcagctgtggtatgaaggactatatgcatgctttgataaattttgttttatggactatattcatgaaaacaaaaataaaatcacgtacgcagcatcatttggaaggagcgagtatcatgcgaccagggaggagaaggcggaggccgcattttatatacagggaatcgatcatatatctgtgcgggaggaaagtgcggtagaactgtgtcgacaggagtggaaccgggaggcagtggttgttctggatccggtatttttgtgcccgacagaagaatatgaaaagcttgcggataaggggaagaagaccgcatataatcaatatattgcaacttatattttagacccctcgccggaaaagcagcagattattgaaaaagcagcacagaaattagaattaccggtaataaacatgacggatgtcgtgaatgtggaagaaaaatgtgcacagtgggatcttgatatggaaagtgatgtttccaatgaagattggctgcgtagaatacgggagtgcacattttttattacggattcttttcacggaacctgttttgcccttatttttgaaaagcagtttctggcaatcggaaatgcatatcgtggattagaccgttttacggaaattcttggtaaagttggtcttaaagatcatcttgtatccgcggaggagatcgatacgctggaagagaagctggggcagagcattgcgtatgataaagtacggagtgcgttgcagagagaaaaagaaaaatcgggagaatggctcaaaaatgcaatctgtgccggaaaagagaaccggctttccggttatgatattattcagaaggaaagaatgaaagaggaagaacagcttttctggcagaaaaatatgattgatgcacatggaaatgtacttggagcacatgatacaagactggcagtatatgacggtgcattgggggaattgcagaaagatgccgagcagagaagaattctgtttgagatacagcagaaacagatgcaggaatttcaagatgcaatcctccagttaagacagcagaaggaagaaatgaattccgttctgtgtgagttgcagggaaagaatcaggctctggaggaagaaatcaggcaaataaaagagaaattcccgttgaaacgctgggcaaagagattcatacaacggttcagaagaagataaacaaaggagaaaacgatgattcagataggcagaccatacatagaacaagcaggtaaaaattttcggctgacagcagatgtcgtgatggatcaggaaacaaaaaagtggtggtttgaagtacccgctgaatataaacagtatctgtgtaccgagagaagcgatgcctttctcatagggatacttccactcgcaatgcgcttcggcgaagatatatcgttggatgccccggttacagaggagcttttatttaatatagagacagaactaatcccgtcattggtgaacagcagcaaaaatttgtatgcaagcaggatattcgcagagacagaaacagaaattatcaatgagggcgcctggggtgtcggaacgggaaattcaatgggagtagactcttttcatgcaatagaaatgtcattgcataatcattgtaagagttatcatttaacccatttatgtcattataatgtaggagcgtttaacgatacatacagcacggcaggagaggatgaggttcgtgaaatatgccttagaaatgcaaaacaggttgcagaggagtatggtctgccgatgttgatatcaaactcgaactatgaggagattgtggatatcaaccatctgtttgtaaatacctatgcgaatttatatgcggtatattgtctccaaaaattgtggaagacctattatctggcatcctctgagtttggatttcacagatttcaactggaagataatgatatgtacgacagtgcacattatgatctgttgaccgtgaattgtctgtctacgcgggggctgaaaatttattctgagggcggagaacggaatcgccttgagaaaataagagatattgtagattcggaggttgcacagagacatcttcatgtatgtgtgagagaagcttataactgcggtgtctgccataaatgtaagaaaacattggtggcgattgatgcgctggataagctcgagaactttagcaaagtatttgatctgaaggcatatgcagtgcacagagagaaatatctggaagaaatctgtgagttacacatccagaatccactagattataatgaaccaagttttcagctgttaaaacaccgcatgccgcaggaaatatgccggaagtatgcagatatccttgaccttggaaaacagcaatatgagcagagaggggtatgcgagattgacggcgtgctcagttatgtgaatgccgatggatataaagcggaagaaggctggatcatagaaggcagaaagcggtattattgcgttggagatggaaaactggtcgttggaaatttccatcagatcgatatttcctggtacttttttgatgtggatggaacgatgcaaagaggcttaaagcagattggaaatgacttttactattttggaaaagacggatcactgcggagaggtttacagcagattaacggcgaaatgtggcatttcgatgagactggaagaggaagtgacgcaggatggatacaggttggcagcagaaaatactattgctttgggcagggaagattggcaaccggtacggtctgcattgatggatcgaattttgagtttgaaacaacgggtgtcatgaaatagcacttaagggagaacgttatgaagttcatgtttgcatttggtctggcaagtattatgctctgtataggaacgttattgcgggcaaaggtgaaggtattccagaaaatgctggtgccctccagtgtgatagcgggaattctgggtttctttttcctgaatgtgctgtcactgcaggatattgactgtggagcagattctgcgatgtatacggaaattgttaatcaattatttacaatttcgtttatttctattacgcttacatcagcgcccggacaaaataaaaatacggcaaaaaatattatgagtggtgtatgggggatgggaattgtctggtgtattctgtacgcactacaggcgctgtccggcatgctgattgctaccgtgctggggaagtacaacggaatggataatgcttatggaaccctcgtagcatttgcgtttgcccagggaccgggccaatctgcggcgtttggaaaaatatacgaaggatatgggtatcagaatgcagcaatgatcgctgttacatttgctgtaatcggattctgcatggccttcctggtgggaattccgttcgcaaaaaagggaatcagacagggctatgcttcaaactgcggcagaattgagccggcggttttgcgcgggtattacagaaaagaagaacagacagagtatatggtaaaggatacgacctgtaacagtaatatagagacattgacatttcattttgcggtcataggagtgtgttacatgcttgcgctgggaatttcaaagatcttttcctgcattcctggttttttcggcagttccatgagcggtctgatgtttatgaatggtatgttcgcagcatatatcgtaaaatggatcatgaaaaaaactggagtggactttttgaaggaaagcacactgcaaaacaaaattacaggctggacggcagattatctggtggtgtgttcttttatggcagtagaagtaaaggtacttgggaaatggatgatgccgattattgtgatcagtattgccattacggttctgacggcagcggtatgctttttctttggaaaaagatttggcggaagcaatgattttgagcgtactttaggcttatacggaacatgcacaggaaccgtggcaagtggtatatcattagtcagaattgttgatcctgaatttaaaacaaccacagcactggagctgggaatgatgaatcttgttatgctgctaagtacaccggtgtatattttactgctgggaatggcatcgggcgaagtgggaaaaacagtgctggcagtgtctttgagtgctcttgtggtaatttatgtggtattgttgagggtatttaaggcgtttggaaaaaggacttattaaaacatgaaaacattgtattatggaggtccgattcttacgatggagaatcgggaagacaaaccggaagcggttctggttcagaatggcgtaattaaaaaagtgggacatttggatgaacttagaaatatagccggaaagagagtaaaagaatatgatctgcgtgggaaatgtcttatgccggcatttattgatgcacacagtcatattacgatggcgggacaggtgtctgtgctggctgatctcacggaatgcatgaactataatgacatcgttcaaaaattgaaaagttatataaaagatcatcatgttaccgcaaaacaggcggtgctggggtttggttatgaccataatacattgtgtgaggaaaaacatccgacaagacagatactggatatggtatcgcaggatataccgattatgatactgcatatatcgggacatatggcgtgtgtaaacagcaaagtattgcagatgtgtggcattacccgggatatggatgatccagagggaggcgtgattggaagagaagatggcgggagagagccgaacggctatctggaagaggcggcgatggctcttgtacagagccgaatcggcaaacttgtgaagataagtatccgaaaaatgattcgtggaatgcaggaagtatatattcaaaatggaattaccacgatacaggatggagcgtctacatcgcagaatatagcacttttaaagagcatggcagcgatgcatttgttaaaaacggatgtggtagcgtacccattaatgacggcaaacggttgtgaggtacttcataaaaacaggaaatatgtaggagcatatcacaacagattaaagataggaggatataaactggtgctggatggctctccgcagggacggtcggcatggatgacagagccgtatgagggagaaccaaaaggatattgtgcatatccatggctaaaggatgagcaggtaaatgaatatgtaaaaaaggcagtcgatgaaggacaccagattttagctcactgtaatggagatgcggccggggatcagtttatcactgcctatgaaaaggcagttgcaaacgaccagaccgggcgggacatgcgtcctgtaatgatacactgccagactgccaggacggatcagctggaccggatgaaagaactgggaatgattccctcaatttttgtcggacatgttttttactggggagatattcatataaaaaattttgggcagaagagaggaatgcgtatcagtccggtgaaagatgcattgagccgtggattgaacgtaacgtttcatcaggatacaccggttacaaaacccaatatgatgcattctgtatggtgcgcagtgaaacggatcagtaagaatggcacaatcgtgggagaagatcagaagattgatgtatacgatgctctgaaatgtattacgataaatgcagcgtaccagtattttgaggaagagaaaaaaggaagtataagggaaggaaagatggcagaccttgtagttcttgagaagaatccgcttgaagttgatcagatgaaaatccgggagatcagagtgattgaaacgataaaagagggtaaaacaatctataaagcacaatagcggaaaaaagaggatagggaggacataatgagaaaaagattattagcaggtatattggcagtcacaatgatggttagtgccgtgatctgccctaatgatcaggtgctcgtaatggcagcagaaaccgggactgagcaagtgaatgttgagtccaccgaggtaaatcaggaggaaacacaggtgcctgataaaacggaggatactataccggaagagacagaaaaaaatgtggatgattcgcaaaatacggaatcatccgaaacgacagaaccagctgaagggacggagacaacggaaacagtcgaggaaaccgaggcaacggaaacagtcggggaaaccgaggcaacggaagtagtcgaggaaatagaagagaccgaggaaaccgaggaaacagaggaagcgagatactacatacagtatttggtaatggaatctgataagatttctctgaatgagacacaaaaagttgtacttggaattgactgtgaaaaagaaatcgattatgcaagtctcgagtatcataatcagcagacgggagaagtgctttcacaggattctaaaggggtaacagatggagcaatcttatttgaaattgcatttcagaacgcctcacaggaaggctcctatcagcttgatgcggtaacgttcgtagttaacggcaaaaaatataccgagaatatcaaggacgctggaattgatgctgtatttggtatggaacaggatgtcgatgtaagcccggatgcgattattgaggatgaaagttcacaggatggcagcgttctggatgatgcagatattgtccagatcgatgaagatggaaatgtaatatcgcagaattccattgaggatgcacttgacagcgtcattgaggaagacgatggaatagcattgtttagtgcccgcagggacattgtcgtcgtattggacccgggacatgacaacagtcatactggagcgcagggaaatggattaagagaagaaaccattaacttgaaaattgctgcatattgtaaacaggaattggaggagtacagtggagtaaaagtatatcttacccgacctacagatggaagctgcccatatcctggaaccacttcaggggtctgcaatgaagatcgtgtaaaatatgcgtcaagcgtaggcgctgatatttatgttagtctacataataactcttctacaaatacatctgcacatggtgcaatggtcttttacccaaacaccaattataattcaggcgcgtcacagaccggaaagggattggcgcagttaatagagaaccatctggttgcattgggattatataatcgtggtattacgatcaaggatgcgcagcaggataagtatccggacggaacagcagctgattattacggagttatccggaattgtaaactggcaggtattccggcaatcattgtcgaacatgcatttgtaagcaacagtaatgatgcaggaaattatttaaatacagatgcaaaattacagaaattaggagtggcggatgcaacggcaattgccgagtattatgggttaagtaaaggggttaatgtcacatcagacagtataaagattaccaacctgaataatgcggccggcacggcaacactcagtgtcaatggggtaagtccggatgataaagtgcgtgcggtgtcatttgccgtatggtcaaaggcagaccagagtgatatatactggtatcacgcaaccaaagtgggagttggaggatacagttcgaactttcagataagcaatcacaaatataatcaaggtacttattatgtagagggatatgcggaagatatttatggtatctctcatttattgggacgtgcaagctgttcatttagcgtgaccggaggaagcgtatcggtacgccctgtcacagccggtcaatatacattaacacttacaggcgtaaccgtaccgggaggaacggcaggagtttcttttgcggtatggggagatgtgaatggtcagaacgatttaagatggtacaatgcgacaaaaaacagtgatggatcctggagcacaatccttccgattgcgaaccatggggaactgggggtctatcacgtgtgggcatatgcagtcaatatgggactcaccagtacatgtgcggtacagacagcgtttgaacatcaggaaacggcttctgttcaaagtattgccataaaaaatatgaacagtacagcaggaacttttgacattttcgtaaacggcgtgcaggcatcctgtggggtaagcaaagtgcagattccggtatggagtgaaagtgatcagagtgatatttactggtatacggcgacaaagcagagtgacggcagttatgcggcacaggtaaacttaaagaatcatggatacaactattcaacttataatattcatgtttatgtgacatccagcacacaggtaaaaatggtagcgggagttaccactacagaggtatatccgcctgcagttaatttaaaaacagaacttgcagcggatgagctgacatgtaatttgacggcaagcaatgtaaaattatctggaggcgtgcagaaagtttactttgctgtctggagcgataatggcggacaggatgatctggtgtggtatgaagcacaggaatctggaggagtatggaaaagaaacatttccattgcagatcataaaacagatggaacgtatgaggttcatctttatgcggaaaacagcagtgggaaaagaatttttatgggaaataccacatttgatgtttcttccatcagtgtccagaaaattcaggcaaaaaatgtagatgcggtcaatggaagttttgatgttgtggtatccggatttgtttcaccatccggggttcacacggtacaggttccggtatggagtaagagtgaccagagtgatattcactggtataccgcggcaaagcaggcagatggaacttacatagcgcatgtggagatttcaaaccatgattataactatggtaagtatactattcatacctatgtgacggctggaaacggagtatataagtttacaggatcaacaagtacgtccatttatccactgcaggcaacagtcagtgcagtattgtcatccgatgaaaaaacatgcagcctgtcagcaagcggagtgcagatgccgggaggcgtgcagaaggtttattttgcagtctggagtgaagaaggcggacaggatgatctggtatggtatgccgcagaaaaaagctctgatcggaagtgggatcgggatattttgattagcagccataaaacggccgggacatatcaggttcatgcttatggtgaagacagtacaggtaagagaacggtactgggaacgaccacgttccaggtttcaagtttaaaaatccagacgatacaggtaaagaatctgctgccggcgagtggaacgtttgatgtgttcttttccggaatccagtcgccatccggtgtaagtaaattgcaggttccggtatggagtaaggatgaccagagtgatatttactggtatacggcggcaagacagagcgatggaacgtatgcagttcaggtaaacctgaaaaatcatgattataattatggaaaatatacagttgcgactggaatgacagcaggaaatggaatttatcagtttacaggagccgtatcggtacaggtaaatctaccaagtgcgagtgtgcgggcggtgctgtcatccgatgaaaaaaccagcagcataacagcggaaaacgttgctctggcaggtggagtacagggagtttattttgcagtctggagtgaggccggcgggcaggatgatctgatctggtaccaggcagcaaaaacaagagaaggcacatggaaaacagatatatcgattagcagccataagagcgaaggggtatatcaggtgcatctgtatggagtagaccggaatggtaaccgtgtatttatgggaaataccacgtttaatgtgtcttatatgtccgtacagaagatacaggtaaagaatctgaataacggaacaggaacatttgatgtattcctgtcggggattacagcaccatcgggggtaagcaaagtacaggttccggtatggagcaaggcagatcagagtgatatttactggtatacagcgacaagacagagcgatggaagttatgctgcacaggtaaatataaagaatcatggctataattatggaaaatatacgatacatacttatgtgacagcaggaaatggtgtatacaaatttaccgggtcgacctctgcaacaatcaatgttccgacaacaaccatgcaggtgggaatacaggcggatggaagaaactgtaatctggtagccaataatgtgggattgcagggaggagtaaaaaaagtttattttgctgtctggagtgagaccggcggacaggatgacctcagatggtatgaggcatccaacacctcctctggtgtatgggtgaacagcttcctactctccaatcataaaacagcaggcgtttatgaggcggatacatatgcgatagacagccagaacaattatgtgccgatggcgagcattaagtttaccgtacagggaccaagcgcttctgcggttaatcttgtaaattataatgagtcagatggaacttttggcgtaaaagtgtctggggcaacgtcgccggcgggaattgcttcggtaaaggttgcagtatggtcagccggaaaccagtcggatctggtctggtatgatgcgacacataacagtgacggaagctacgtcattggggcagatgtgcggaatcattccaataatacaggaacatattatgcggacgcatatgtatatgacaataatggaatcgcattatgtgcagggcgtgtgacatgctccatgattcaggttacaaacctgctgcatcccatcagcggttcgacatctgtgacggtacagcagatggtaaactattataatacaaaagcagtttatccgtctttctaccagaatacagaggcatcgaccatacaggcattctgccagatctatatcgaggagtgccgggcggaaggaatcaaagcggaggttgcattctgtcaggcaatgaaagaaaccggctttttgcggtatggaggaaatgttcagatagaacagtataattttgcaggaatggggagcacggggcctggcgtgaggggggaatcatatccggatgtcagaacaggaatccgtgcccaggtacagcatttaaaggcatacgccaatacagacagtttgaataatatctgtgttgattccagattccggtacgtgacaagaggaacagcgccatatgtcgaatggcttggaatacaacagaacccatacggaaaaggctgggcaacagcaaataattatggatatcagattgttgatatggtaaataaattaaaacagaattaaagaaaagtcgatagagaaggactctatcgacttttttaatgcaaaagtaccagaaaggatggactttataggggtagaaatgttaagataatattaagatttagatcatagtagccatttaacaattctagccagggaaaatgagggaaagatgaagaaaaagaaattatttgtgagtgtcattttattaatagctcttctggtgtctgatgagtcggcggctgttgccgcagcggagatgccggttctgcctgatagcgggatggtgtcagaaagtgagatgcagttggagacagaagaggaaggggatacaacagagatatcggatgagacagcggagaatgtagaagaaacagaatcgatcaaagagacagaaacgattgaagggacagaagcgattgaagaggcagaagcgatcgaagagacagaagaggttgctccttacacagccgaaccgttgagtctttccatagagtatccggctgatataaaatgtggaacgccggtcacgtttacaatgaacgccaggggtgggagtggaacgtataaataccggattcattccttattcaattccgaattgaaaagtgtctatgatgtcagctatggttccaatggcagttatcgggacagcaaccagtttacgtttacattttatgcatcgggcatctattatatcaggttcagtgtgattgatatgtccacctatgagacaaaggataccggactttatgaatataagattgacatacaggatgataattatccttcggtagatcagattgtgtccgacgttactgcacaatgtgaggcggaatgtacaacggattttgaaaaggcgctctggctgcatgactggatcattgatcatgccaattatgattattcgtatacctattgtgctccggaaggcgtgcttgcgaggggaaagggaacatgtgaatcataccattcggcatattgtatgttgttaaacaaagtcggtattgctacaggccgtatagagggaaatggtcatgtgtggaccgcggtaaagatggatggagaatggtatcaggtcgacagtacatgggatgacatgggagatgattataagggcacgatttatgaacatatgtattttggcctgacagatgagattatcagttatgttcacagtgatcataaagctgcggtgccgggttatgagtcgacagcgcttgcagacaattattttataaaaacaggagagatcaggcagtggtcggatcccttcattgatacgatcaggcagaagataaacaatggtcagacagagtttgtgctgccggtcacaagcagtatgccggataattataataatgttatctataatctggtggcatatcagctgtcaaaggaaaactggggaaccaaagcccttaatgttacatacgggagcggtcagcttacctgtaaagttacagataaggcgcagatgtacgcatctgtgacggcaactccggtcatgaatgagacggcatatcacattgtggtacaaaatgtcagtgaaacaggtggaataaaggaagtccaggttgcagtatggagtgacaagggcggacaggatgatctgatctggtatacagctgctccggatacaaagggcagctatgaagtgaatgtacctgttgcaaatcataagacggaagggatgtattacgcccatgcatatgttgtgaaccagcagaaccagaaaagatatattggtggtacgacatttacggtatcttcaccgggagtaacggtgcggccgatggcaccgggaagatacctgctgacactcgaggggctggctgcatatagcagtgatattacaggcgtatcgtttgcggtgtggggacaaagcgatggacaaaatgatctgcgctggtatacggcgtctgcggatcagacaggaaaatggcaggcagaaatttccgttgcggaccatggggagaacggaatttactatgtaagtgcatatacgagaagaaaaaatggaacaaacacctgtatggttgcaacagcatttcagcatacagagtccgtatcggtgcaaagcattgaggtgaaaaacgtagatgcaagtgcaggaacatttgatgtgtttgtaaagggagtcaaagcagactgtggcgtagaatctgtccagctgccaatatggagtaaaagcgatcagagcgatatcgtatggtatatggcatggcggcaaagcgatggaagctatgccacccaggtaaatttaaagaatcataattacaattatgcattatatcagatacatgtttatgtaacatcgggcacacatattaaaacatttgcaggattaacatctgtcaggatagagaaaccgcagatcagcatgcgggcagtcctgtcaacagatgagatgaaatgcagtctcacggcccggaatgtggcggtaggcatggggtacaaaaagatatattttgcagtgtggagtgaacttgggggacaggatgatctacattggtatgaggcggatcaggcatatgtaggaacatggagaaaagaaattgcaatcgcttcacacagaacgcagggaaaatatcaggttcatttgtatggcgaggacgcaggaggaaatcgtaccattcttggcacgacgactttttctgtgtcaaatgtaacagtacagtcgataaaagtgaaaaatcttaacagaacgacgggtacatttgatgtatttttatatggcatcgaatcggcttccggactggaaaaagtccagattccggtttggagtaaggcggatcagagtgatctgatatggtacacggcatggcggcagagtgatggaagttatgccacccaggtaaatatcagaaatcatggtagctgtcgtggcaactatacggtacatacctatgtgacaggaaaaaatggcgtacggatgtttacgggagcgacaagggcgtccatcgtaaatgctccatagtccatacatagaatgctagcagcaaatttgagaaaatagactaaaatattaagacggtcaaaaaagtgtagtccaaaaagtttaggatatacttttgagacagatggaggaagtctatgaaatctcaaacagcattggttgcacgtagttgtcggcttaacgagtgggtccaaatgattcacgattgtaagaatcgccctgctggcatgtccgttgatgaatggtgcaaacttaattctatcacaaaggcaaactattattatcgaatgaggcaagtcagaattgcctgccttgatgcattgcctgcagagacgttagagcatgcagtggttcctgttccgttagcattaatggaagagccggcaggtatttcgcctgtatcttcgaataataattcttgccttgagttatatgcccatggagtgacgcttcgcgtaacggaagcaacttcagagacgctgctgactaaggtacttggggtgcttgcccatgttgaatgatgctacgtgcttcaaacaagtttacattgtttgtggatacacggatctaagatctggaatagatactctggcatcaatcattgatgcgaagacagataacagtccatttgtcccagatacactctatcttttctgtggtcgcaagtcggaccgcatcaaaggcttggtttgggagaaagatggttttctgcttttatacaaacgccttgagcaggggaaatttgtatggcctagaaatgaagcagaagtccgggctataaccattcaacaattccgctggctgagggaaggcctgaccattgctcccaagaaagcagttcgggaaatcaagcctccagaacatatggcatgatgattgtgcaaaaggtagaattttttgccatgaaaaatggtcgtgtaattaccgttttttcatcatcatcaagtcccaaaaacagtattgtaagcgagctattgtgcttttatgtagttgtaatttatatccagcatttcaaaaggattcgatatcatgctgggtctaagccgcttgtagggtcaaacaaccataggcattatgacgaactctgaaatgagaggtattcactatttaagaccatatgcgctataatgaatcttgtagaaatgaggttcattatggcgatggaatacacagaagaacaactgaataatttcgataaggctacgcttgttcagctgtttcttgcccagcagtcacagcttcgcgatattgatcagaagcttcagctattgctggaacaggtcgctgttttgaaccacaaccgttttggcagatcctccgagaaactagaaactgaaaatcagatcagtttcttagaggtggatggcaatatcatttacttcaacgaagcagaggcagttgaaagccttgccgagtatgaagaaaatgaaacaacaaaacccagaggcaggaaagtccagggaaagcgtgctaccgatatccaaggacttccggttattcctgtagaacaccggatgacaaaggaagaacttatctgtgaattcggcgaatggggctgaacattgaccgtgccgacatggcacactggaccatactttgtgccgaacgatatctttccgtcttttacgactatctgcatgaaagaatatatgattatcatgtacttcaggcagatgaaaccccggttttggtttcaaaagagaaccgaacggagggaagtaagcattacatgtgggtgtaccgaaccgacaagatgtatctggataagcagatcgttttgtatgagtaccaaccctctcgtaatgcaagccatccaagagcatttctaaaagatttcaaaggtgtctgcgtaacggatggatatcaggcctatcacaccattgaaaaagagcgtgaagacctacggattgccggctgctggagccatgcaaggcgccgattcgacgaagctgttaaggctttgccaaaggacaggcgaaaaagttcgctcgcatatctggcattaaagcagatccaggcaatctatcgcgaggaaaacaaacttgcatcaatgactatagaagaacgtctaaaacattgccagctaacagtaaaaccgctggttgatgcctattttacgtggatcaaatagaatctattgtctgtaacgcctaagagtaaaactgcaaaaggacttacctattctctcaatcaggaaaagtatctaaaaaccttccttgaagatggagaagtaccgatggataataattccgtggaacaggcaatccgaccgttctgtgtgggcaagaaaaaatgggttatgattgacaccatagctggtgcagaagctagtgccatcatctacagcattgcagaaacagcaaagtcaaacaacctaaagccttacaattacttcgaatatcttttaactgagataccaaagcacatggaagaccatgatgtaagtttctgtgaagatctgctcccttggtcagacaagctgccggcagaatgcagaaagtaattcgttgactaacgccgctcttcggagcggctaatcaaaagaccgcacccactatggtgcgtttacgataataaaaagaaaaagttgatttgaggatgaaaatggatcttatgcaagttttaatggaagaatataaaatgttggggcaggtgggagaaaagtattttgatagattatatcaaagcctgtattttaccattgttttttatggggcggtcttggcagtcatgaaatcagaagacaatgaaaaattctggttcattatattttgttattttttgccaataggaacctttttatttggacttttttatgcatataattcttatgtaatagcaaggcaagggttttgcatgattaggttagaaaaaatgattcgggaacaaggtctgtacgcatataagaatgcaggttttgcgggatggaatatattatctaaaaagtatgcaggtaactataagttagcatatgggacatcattgatgttttttgtttttgcacccgtttttgactacatattaggaattggaaaatcagattttaaatggataataaattttacatccattacaggattaaatattttgtacagtatatttccaatactattttatgtggtatatgttatttttatgataataatgataaaaaatatgttgataatgaataaaatgatctatgtggaattataagagaaattcgtgtgccgttgaaaaggagaatgaatgatttagaactgcggttttggtactaagggcaatagtgcttatagaaaaatatattcggaggaccaatagtttcattgataataacggaagtagtagatgcgatagggtatacaaaggtgttttttgtggcgtgtatattattgacttaaaaaattttaataaacattggaaattacatgaaatgttataaatgataagatacgaaggtttgcaaaaatgtatggatgtagtagaatataatgaaataaactacatcacatggaaaacaggacgataatgttgaaaagaaggtagtggaaaagatggataaaacaatggtggaagagactacgataaaagatctgaaggactgcatggagaataatatgccagtgctgtttttgggtgctggtttttctcgggaagccctctgcaaaaaagggaagcttcccacaggctcggagcttgctgatgaattacgattggagtttgtaaaagacaaaatcagtgaggcagattataaggatgttgaaaaatataatcttcgtgaattgtgttcctgtattgatgcattagataaggacaataaagcaaaaagagaagagtatcttacaagacgccttaagggagccttgccaaatgagactggatttcacaatttgctggtggattatccatggaggagaatttatacggtaaatattgatgatctggttgaaaatatatatgaagaaaatgacaaagagtacagttgtatttcatcaagtaaagatattccccgcaaaagtgaaaacatggagctcattaaattacacggcagtgtaagaaaaccgggggatggctacatattcagtaaaaaggaatataatgatctgatcggaagcaaagtgaatatcggtcttgtagaatttacaaatgaaatatattctgcaaatgatgtcatatttatcggagcttcactggatgaaccggatattgagtactatttacagctttatgaaaatatgcagataaagagaaagaaaagccgtattttctttatagaaccgtatcccaaattggcgttggagcaaaaagcggcagagttgggggcgaccattattccgtggactacggagaaatttttaaaatttgcatcggagctggaatatgcaccggagagagcagagcgcgccagattagaacttaaccgggctatgatctatcggcttcaggatgatataaaaatttttaaaaatccatatgagagtaatatatatcagggatattatagcacctggcaggatgtttttgacagatggacatttgaaaatacgatgttagacagtgcgaaaaagagtctggatattattttgagtcaaaaagatccactaaaatgcttttgcctgtatggaagctctttttcggggaaaagcacacttttaaaacagctgggctattatttgcatagtatgggatatgaggtacttgaatataagggaagatttttagagagaagtgtacttcgcaactatattatggaaagtagctatgaaaaatatgcaatccttatagataatgcaagtttttattataagaccattgagagatttttgagagacagttatgaagaaaaagaaattgtttttttgtgtgcgtccagaacgtattatcatacaagaaagaaatattatctggaagggaactgtttttgtgatttagaatgtaaagacaaaatcaggaaagaggatgcgcccattatagcacaaacactggaagagaaggattcactgggagatttgtacgaattcgaccatgattcaaatgagctgtatcgggagattcagaggaagcagagtgttgtgaatctgatcgtatatctgacttatggcaaggaaatgcggcgaaaattaaataaggaaatgaagtttgtaacggatcttccgccgatagaaatgaaattgctgctggaagtggcaatatttaataatctggatattgaatattatccgatcgaattatttataggacgttatcagggggtaattcgtctgacggaggagggcgggatcagtaacctgaaggtgatagattatattaaatatgatgatcagggaattgctttaagaaactctctgcttcaggatgcggttttgaaaagtaacagggataaaatttttcctgcaatccgggaattgttgctttatatgtcgacttatgtgtatgaaggaagacaggatgtgtggatgaatgtattccaagcacttttaaatgaggccaggttaagagaaaagtttaagtcggaaaaatcggaattgggtactttgttttatgggattaagcaggaatatacaaaggtcagctattattggcttcaactgggcttatatgaacagggagagaataattatgcaaaagcactgagccatttgaaaaaatcccaaaagatacaaccgaaatcttttaagatacagcatgcaattgcaaggaattatcttaaatatgctaatgtacaatccgacagccagacagcaaaggaattgtttgaaaaaggcgaaaagttgatgctagatctgatcaaaagtaaggagtattatattcaaaaagcaaaactgttttctgttgattcttatgtgctggaaaaggttagatatgtagaaaagtttcatgtaaaacttagtaataaggagttgaatgaaatgagagatatgctgagcgaggtttattcacctaatgattcctacatttataaggctatgaaagttttctatcaaatgctatgcagaataggaaaacaatccatcatacgaatggactttaacagtccttattatgatattatgaaaaaagaatttgcaggagacgatgagtttgaaaatactatttattgtgaggagtaggtattatttaccaaaaatattgtattgattagtaaagtgtcaaaagaaatctgatctgtgtgttttaataattcataattttaccaaatagacatttgacgaaaaagagatttataatactcccatagacaggcacttcccaatgaggaggtacccatgtatgggagaatgttttcagacattgaacttgacaaatgcatatttgtttgcagcggcgctacaggatgaggaaatctgtcggaatgtgctggagatcgctttgaaccgtaagatcactgcggtcagatcgcacgcagagcatacgctcttcctcgacagcgatttcaaatcggtgcgctttgatgtgtatgcgctggatgctgaggaggtcagctatgacgttgagatgcagaatgattttggcagggatctgcccagttgctgcacctgtttgaatatttgaaacaaagcaccgaagaagttgccaatatgcataacgatgaagagattcaactgatccaccggagggtggaatatttaaaacgtgatcgaaaattggaggcgggctatatgacgatggaggaatatagccattcggaagcggagcggagagcaaaagagatggcggaaacgctggcaaagccaatggcagagtcactcgcggcttcaaaaatagcgcagaacatagtggcgttattagctgaactcggaagcgttccggaagaattaagggagtgtattgcagctgaaaagcgggaagatactctggcggcgtggcttaagcttgcagcacgcgcggattctattgaagagttccagtctaaaatgtagagacagatctgtctcattcttgatcggtagtttcaaccgataaaatctacaaaaataattttgggatgtgcctgtctagcaatctgcaatagaaagtggaaaaggaaagagaaatatgttaacataattgttgcaaggcaggaaatttggaatgccatgtggtatttgtgcaaaacaaaactactataatagaatgaaaacggatacacaaaaatctgcaatgatagaacaaatgatgggtggaaaaagctatggcaacatatgtgattggtgattatatcagagagatcaggcttcgtaagggctacacgcaggaggatgtaagctttggaatttgtacatctgcaacactgtcgcgcattgaaaatggagcgcagacacctggcagatatatactggataagttaatggaacgcctgggtatggagaacagtgtgtttaatatcttcgtgagcaaagaggagatggaactctatgagtgtgtccaggaaatggtaagaaacattgcggatgggaattttgaggaattggtaaagcagattcagaaagtagaaggtctgacaaagaaaacatcacacttggaaagacaatatttatactttgcaaaggctgaattgatgtggaacaaaggggcagaaccggatcaaatcatggaaatgctcatgaaggcaatccatgttactttgcctcagtttgacggtgtgacaccgatgaaggaaaatctgctcacatttgatgagattatgataatcaatgcaatagcaaggaaatatgccagagaaaataatattgaggaagcattgaaactagaatactggttaaaggattatatggaagagcagatgatggacagtaaacagaaaacggcaaaatatcctgtcattttatataatttgagtaactggctggctagagtacaaagatatattgaaataaatgatattgcagaagaaggagtagaattttgcattaagtatggcaatttggttattcttcctcggttattatttaataaagcctgtgcattagcagaacttggtcaaaagggtgaagcagtcaaatatttcaggcagtcagtcgttctgtttgaaacgatgaagcagaatgagagagcatgcagagcggctgactactgtaaaaataattatggtattgaattttagtatccctcagccatatcttcgaaaataaagcatgaagtcacgccggatgataccccaaaagaattgacgatacctggtactgcggctgcggacaagatgagtgcaagtgtggtgataataaatgcttttttcataaacaaatctccttttctgttgctttttttgctatattaggagaggttttgacaaaagaccattcgatatgacgtaagtttaaatttacgtcatatcgaatggtcttttcctgtcgaagggagtaaaataaactaatttcacacatatgaaaggaagagataaaatgatagaatgcgtaatggtagacacacttccggagactgcaaatcagatccttaatattttgtgggatcgtaatcatgcaatgaatgagactgagatcagggaggcattggagcaggaattttctgtgaagtgtgaaaagcaggatgtgaaggatttcataaggtttctgatcgggcaggattatgtggagaagaagcataaagggttgaagacctgttatgtggcactgggagctgattacgtcttataagcatatgcttttgaggaaaccctcatgatatcagaaagcggtgtgaatagaagtggcattttggagcggaatgttgtagaatataaaaagtattacgacagaaggagatgctatgaagatttcactgatagtcccctgctataatgaggaggaagcattgccgattttttatcgggagacgaagaacgtgttggaaaccatgccatgcgagcatgagtttgtgtttatcaatgacggatcgagagaccggacattggctgtcttaaaggaactggcagggcaggatggctgtgtgcagtacctttccttttccagaaatttcggaaaggaagcggcaatgtatgcaggattttgcaatgtcaccggagactacgttgcagtgatggatgctgatatgcaggatccgccggcgcttcttccggagatgttagacaagcttctgacaggtgaatatgacagtgtagcaacctgccgtgtgaccagaaaaggagagccgccgattcggagctggtttgcccggttgttttaccggatgatcaaccgcgtgtcagatgcggatatcgtggatggggcacgggattttcggctgatgcggcgtgagatggtagatgcgatcgttgagatgggagagtataaccgtttttccaaggggatttttggctggatcggatttcggacatgctggctgccgtatgagaatgtgaaccgggtggcaggcgagacgaaatggaatttctggaagctgtttaagtatgcgattgatgggattatcaatttttcacaggcaccattggcatttgcatcctggtttggaatgttcatgacagtgttgtcctttgtggcggtgatttttattattatacgaaagcttgtctttggagatcccgtgaccggatgggcatccacagcgtgtatcattacatttattggcggtgtacagcttttttgtatgggaattatggggcaatacattgccaaaacatacctcgaagtaaaaaaacgtccgcattatattgtcgcagagagcaatatggacgaagtgaaacggataaaatagcctgttttaggaaatgtgcacaaaaaacacttttatacgcgggtgaagtatggtatgataaaaataagggcgcagtttgaaattagaaaagcccttaattaataggatattgagaggtatacattgtgaagaaaagagcagtcaccttattgacattgtttgcggtttctatcaaccttatggcatgtggtggaaaggatgctcaggagagcagcgcggacacatcgactgagcaggttattgcagagacgaccgaacaggcagagactgagtctgaggaagaagtgcttccgggaggcaaataccggagcgaacttacgaatgaactgatcgatgattccttgaaggatcagcgtccgattgcggtcatggtggataatgagtctattgcgttaccgcattatggattatcgcacgcagatgtcgtatatgagatgatgaacagtacaatgaatggtcgtattaccagatttatggcactgtttaaagattacgagagcgtggatcagatcggaagcatccgaagcgtccgcccgacgaatattattctggcagcagaatggaatgcgatcatttgtcatgatggaggaccattctatattgatgaatatctggcagagccgtgttccgaccatttcagtgggacattttcccgtgtgaacaacggaaagtcaagagaatatacggagtatatcgtttccggtgatatggacaagaacttcagtaattcggatgtgtccaaagagtatacatcttattatgagggtgagcactatcagtttgcaaatgaggacaacccggtggatctttcggatgcagcagacgcgatcacagcagagaccgtggatcttccattcccgcataatggatcctatctggagtacgatgcagatgatcagttgtattattattccgagtatggcaaagcgcatgtggatccgggcaatgataatgcacagctctgctttaagaatctgctgattcagagtgcaggatttacacagtatgacgaacatggttatatgatttttgatgtgattacatccggtggtggatattatgtgacgaatggcgaggcgattccggttacctggaagaagacgagcatgacttccccgacacgctattatgatgcagatggcaatgagatcaagttaaataccggtaagacgtatatagcacttgttccggtggatgactggaagagtctggtaattgaataaaacataggtgacagaaaaagacacgtccatttgggcgtgtcttttttttgatctttgccattgatttcttatctgttaccagtagcaggcattgtccagttcttccagtccttttttgtccttaggagcttctgcttttggtggacgaacccaatattcatttttgagagggaggtagggagggtagtcatcccaacgcgatccccagatcccgaagagcagctgcatggatccccccatctgaatggcctgtttgccggcgcgttttaacatcggagccagattatagccgaaagcactgcagctgagcagggcaatatcaaaatcgatcttcatgatctcctcatacatataatttaaagcatcaaaccatgtgtcaaaatcgtctccgcgtccggtgaaccacacggctttgaatgtgcggaatgtgatgtcaggtggaagaaccatacgatccgggaagatctgatccatgtgggggtactgctccaacatggtatctacgaatgggttgacgagaagaacctttttgccggcaagagccagtgtccagggctctttgtaagccaatggttccaactgaccgagacggatcagcttcatatcttttggacagctggtgcgtacaatgtattcttcggcaggatgatcgtcaaagtaagccatcacatcgatatcctgattatcacgtttgatcagagacgaccagcggccgacttcctctgtgctgtggtgaaacgtttcaaacatattactcttaccaagacggttcgtgtggaagaggacatgctcgtcgtagagctgcaactctgaaaactcagcgctgccaaggcgacagattgcaaatggcttgccgcttttgataaagtccttgatcagctcattggcttcttcgtctgtcggagccggaattcccagaaaagatccgagaacgttgtaacttccggtgcgtctggcgcggagtttatgatgaatgtgcttcaaatagtagtataaatagagaaccctctgtttcatgaaatctccttatagaaagtggtcaatacgcaataatttttattataaatcctgcgtgtgcaatgtcaagggaaaaagtggacttcgttgacaaaacaacggtgtttggagtatgatgattgtgtttcacagatgaaagaaaaccggagaaaatccggtagaatggagtagatatggagaagattttggtgacacgttcatccatgcctgaactggatgagtatgtggacgagataaagagtatttttgaaagccactggctgacaaatatgggggagaagcataacagattggaggaggaactggcagaatatctaaaagtgagaaatattctgctgttttccaacgggcacatggcactggaacttctgattcaggcaatgggacttaccggagaagttatcacaacaccgttcacgtttgcatcgaccacgcacgcgatcgtccgcaatggactgacacctgtgttctgtgatgtgaatccggaggactacacgattgacgtaaataagatcgaggcgctcatcacagagaaaaccagtgccatcattccggtacatgtatacgggcatctctgcgatgtcgaggcaatcgaggcgatcgcgaaaaagcataatctgaaagtcatctatgatgcggcacatacttttggcgaggaatataagggacgaggagtggcaacctttggaaatgcctccattttcagcttccacgcgaccaaggtgttcaatacaatcgagggtggtgctgtctgctttaacagcagtgagaatggtctgcgggaaaagctgttcggcattaagaatttcggtatctgggatgaggaacttatcaaggatgtcggtgcgaatgccaagatgaacgagttccaggcggcaatgggattatgcaatctgcgccatattgacagagaacttgcaaagagaaaggcagttgtagagcattacaatgagagactgtccggtgtaaatggattaaagatttctgcaccgcaaaaggacgtgaagcctaactatgcatattatccggtaatctttgaaccggaggaatttggaaagagtcgggacgagatctatgagctgttaaaggtcaacgagatctacgcaagaaaatatttttatccgctgacgaacacgtttgaatgctataagggcatgtttgatatgggagatacaccggtagcgctggatctgtcgaaaaaggtactgacccttccgttgtatgcagatcttcggattgaccaggtggatcgtatctgtgacattattcttggcagatagaagaatctgccggtggcggatgttgtgggaatttacaggaagaatgcaagcgtggaaacacaggagaaacagggaggatcatgatttggtaacggttaagatcggcgatggcatgggcaaccagatgtacaactatgcctgtggctatgctgcggcaaaacggagcggggaaaagctcaggctggatatatcggagtgtgataattcgaccttgcgtgattatgagctggatcatttccgcgtggtgtatgatgaaaaagaatcctttccgaaccgcacattctggcagaagctctacaagcgcctgcggcgcgatatccggtatcatgtgatccgggaacgggatatgtatgctgtggatgcgcgggtgtttgtaccagcccggcggggcaggtatcttcatggctattggcagtgcctcgggtattttgaagaatatctggatgatctgcgcgaaatgtttacaccggcatatgagcagacggatgcggtaagagaactcatgcagcaattcacacagacgccgacttgtgcactacatgtgcgtggaggggatcttggtggcccgaaccgtgcgtattttcagcaggcgattgcacggatgcagaaggaaaaaccggatgtgacgtttattgtgtttacgaatgatcttccgaaggcgaaagaatgtctggatgacggagaagccagaatgcgctatattgcggagtttggggaagcactgtcggatattgatgaattctttctgatgtctgcatgccagaatcagatcatttccaacagtacctattctacatgggcagcgtatctgaacacgctgccgggaaggattgtcattgttccgaagtttcacggggtagagcagatggcattgcctgactggattgtactggatggcggcgcatgtcagaaaggggagatcgatgcagtttaattcaattgactttctcgtattttttccggcagtagtgctgatttactggatcattccaaagaaagtgcgctatctctggcttttggtggcaagctattatttttacatgtcatggaatgcgtcgtatgcgatgctgatcggagcctcaacgctgattacctatgtgtgtggacttcttgtagagtggaccggtacacatgaggaaaaaggctggagcgtggcaggaaagctggtcgtcgcggttggtttcctttccaatctcggcattttgtttttttgcaaatattttgactttttccttacaaacctgaatgtggtgctggagcattttcagaaaaaaccgttgaccagcagcctggaggttctgctcccggtgggaatttccttctatacctttcaggcgctcggatatctggtggatgtctaccggaaagagattgcggcagaaaaaaatccgcttcgctatgcgctgtttgtatcatttttcccacagctggttgcaggaccgatcgagcggtcgggaaatctgctgaaacagatccgggaagtgccttataaaaagacatttgaatatcatcggattgtcaacggactcatactcatgttgtatggatttttcttaaaaatggtgctggcagaccggatcgccattgtggcggactatgcatttgaccattattacagcctggggagtgcggaactggttaccggggcggtggcgtttgcaattcagatttattgtgactttggaagttactccctgattgcgatcggggctgcacaggtgatgggcttcacattgatggagaattttaatacgccgtattttgcgacatcgatcaaagatttctggagaagatggcatatttcgctgagcacctggttccgggattatctctatattcctcttggcggaaaccggaagggaaaagtgagaaaatactgcaacctgatgcttaccttcctcgcaagcggactctggcacggcgcagcatggacgtatgtgatctggggtggactgcacggactctatcagatcatcggggatctgcttcgcccggtaagaaagaagatcgtggagatctttgacgtccgaacagattgtatcagttttaaactgacacagattgcgtttacatttgtgctgaccacatttgcatggatttttttcagggcagacaatctgggacaggcgtgtgtatatataagccggattgcaacaagagtgaacccgtgggcgctttttaacgggacgttatatacaatgggactggagcagtttgaagcaaatgtgttgttttttgcactgttcattctgttgttggttgacctggtacgttatcggctgggcagacgcgtggatgtgtttttgcaggaacagaatatatggttccggtggctggtgtgcctgttgctcattcttcttgtggtcgtgtatggaaaatacggtccggattatgatgcggcacagtttatatattttcagttctaaagaagagcatgaggaaaacaatgaaagaaatgataaaacgtacggcagcctgtctgctgtttgccggtcttgcagccgggatgctttatggggcttaccgcctgctacattttaaatcgacagatggctgttatccggcggagatgttctatcagcaggaggagaataccgttgacgtcttgtgcctcgggagcagtcatacctatacgaatattaatccggctattttgtgggatgaatacgggatggcggcatatgatcttgccggatcgaaccagacgttgtggaatacttattattacatgaaggaggcgttaaaataccagacaccacagcttgttgtggtggatgtctaccgggtcatggaggaggatgagtaccaggggacagagcggatgacgatgaacatgtttggcctgcgccattccgatgattatgtggaaaatctgcaggtcagccttgcgcctgaggaggaacagctcgattatctgctgcggtatccggtgtaccatgcgaggtaccaggaattaaaagaagatgattttctgccataccatggagatgcaaatggtagaaattacaagggatttaacattaattccatcagtacgactgtgtttgagggactcccggatgtgacatgggtgacggaaaccggtaagatggagaaaaagaatgaaaagtacctgaaagagattatagacctggcaaaagagcaggatatcccgcttcttctcgtagctgctccctatatggaggttggcgaggaggatgagatgttatataatcaggtggcagagattgcggcagagcatcaggtggattttgtggatttcaacagacagtttgaacagatcggtctggatccgcagaaggattttgcggagagcagtcacttgaattattacggaagtgagaaatatacaagctatctgggtaattatattgcaaaacattttaaggtcagtgaccgcaggggtgataagcggtatgattcctgggaggcaaacagccgttactatgaaaaacatgcccagaatgtggatttgaaaaagacgaccgatgcgaacgcctattttaaaaagctttttgcaaacacggatcgttatacgatctgtgtgatgacgaaaggagactatcgtagtcagaaatggccgcttataaagtccatgctgaaaaagtatggaatggatcctgacaccgatactgtgtgggtatggaaagatggagaacttcagatgaccgttccggcagacaccacagaagataaggtctattatcaggatctgggaagaaagagtgtgacggtgctcacggaagaacggtatagcgccatgctggatgatacttatctgtatcgggaggtatcgatcgaggggatcaactgtgatgcggcggaaaatgggatcaatattatggtatacgacaatgaattacaggaaatggtagacaatgcaggaatgaatgcttctgacgggtatgcatttatgcgatattagaaaatgaggatgagacggatatgaagaatacgctgattaaaattcagaacttttttctggcacttgccatggtggtgcgccatccggtaaaggcgccggagcttatgctcgcacgccgcaatgaggaagaacttgcagcggatatagaggcaatcaaccgggagagaatccgtacattgtacggacaggagcaggaaccggctgacccggagctaaaaaaaaaagagtatagaaagattaatgagtcctacgaaaaacgcctgatcttccatgtgggatttggggcaggtcttttttccgagctggacagcatgatggagcacatgcttttctgctttgaaaatcatatccgctttgagatctatgctgatgatgccaatttctcaaaagcgggaggaatgggatgggaggaactgtttgagccgttctgcccgatcaatcacgataagctgaatcatatcgcaaattatcgcccgacagactataagagcacgatgcgccaccaccgcctgtggtataaaggatactttttgcccaaaatcttaaaacggcgtacgggtgccgactatctgacacaggatatctggtgtatgtgcatcaataatgattttaagtatcatccggtggattttccactgtttgggatgaagggaacagccacctctcagttttcaaaattcggggagatcgcgatctgtccgaaaccggatgtgcgcaaggagatggatgcactgatctcaaagctccatatgccggaacattttgtctccatgcagatccgcggcggcgacaaatgcctggagtataaggagttaaaggatgcggcaagctatgtggaaaaagtggaggcactgggactgtccggtcagccgctttttatctttacggacgattacacgaatgtgacgaagatccgggaactgcgcccggagtgggagttatatacgttgacaggggaggaagagcgcggatattacaatgaagcgttcaacaggcaggactgggagttccgcaggaagaatcttatcaagctgctcgcgatcgtggagttgtgcaaaaaagcagattatcatatcggaccaaaccagtcctgtgtagatttgtatctgcgctcggtcaaaggactggagcgttatatcgtgctatagataacggattggatcaggaatccgggccattaaaaagagggactgtcgcaataagcatagatctcttttgggtgataagtaatattataagaaacacacttgaggatttcaggtggaaatgcagatggaatattcgttggagaaaaatgtgagtatttcttccagtggaatgtttgcatcggattccgtgtctcttccacgtttggacaatccgacgggtgcatgtccgacacaccggagacaatgggcggactttctggtgtccctaatggcacctcttcacagacaatataaaaccgcgcgaaccgaaactcgccggcatctgctattgaaaatatggcagatgccgactcagacatcggcttcgcgcggttatgttttgttcagaggtgccaataagggacacacaaaagtcctgcaaattgtcttccgggatgcggacatggcccgcggagtgctccaaacttggaaagacacggatcatcgaagatgcaaacattcggctggttagaaattccacatttttcgctccgaatttccagatgaattccatctgaaatcccatggtgtgggcttctaataatattacttatcaaagcaaaacacgatatgcttagtgcgacagcccctctggctttacaggaaaatgtgtccgatggagcgaagatcgtcggacgggatccatatgggatcagtcggtcttacggatcacggtggcaggattcccggcggcaacggtatagggcggaatatcgtgtgtgacgacacttccggcaccgatgacggcaccctcgccgattgtaacgccttttaagatcgtaacaccgaaaccgatccaggctttatccccgatgatgatcggagcatccctcacaaccgaccagtccttgtcgaaaagtaccggtctgccttcctttaaattggtatgctctctggtcacatccatgctgcgtccggcagagtgggtggagtgggaattgtggtcgtagattgtgcagttccatgcgatgatgacatcattgccgatcgagatctgattgcgggagatcagctgtgtgccacctccgatgtgtacgcggtcgcccacggtaatggttcctgtctctgtctcaaagacgaaggaggagtcgatgacaccgccatcgccgatcgtcaggtatgtcttcccggactgtggtgcgcgcagatcaaggttgaaattgtcacagagcaccgtgtccggtgagatggaaaaataaggagcaaaggtttgaagctgtttttttcgtttgtattttttatagatactgcgaaggttcatgggaatccctcctttttcatgcaaatggaagagttacttttttctgagaaactgtaccatgccatcatgtgcacggcggtatccgtttatgagagccggggtgcaggcattgaccggcttcatgatcagtgcggcgagggcaccgtcaatgcgatcaaagagcagtctgcgcagctcgttgagcaggatacagaacaggaacacgacaacggcaaatacgaatacaatgccgatgaaataaggactcttggtgtacggcgcaagatcgaagtactgccagaagaatttccgcgcgtacccctcgatacagtacaggatgaccacatcaccggataagtggttgatgatcctgctggaaaaattcatctcccggaaaaacaggaagaaggagatggcggtgacagcgatcaaaatggagttgtcacgacagtacataccggtaaatactcctttttttaaggaaaggatgatatttagcacggtggcaagaatcgataccgaaaagaacacggcggcaagtttcttttgtgaaaaagagagatcgcttaagtgcaggcggatataacggccgatcagatacataatcgtcatacatacgacaccttttccggcatcttcgatgatctcgtagaagaagaccgtcgggatcacataaaacaggaacagtaacagcaggatcagattgcggaaagatttccggtcaagctgttccgggatcttattcaaaaagctggaaaggatcgtgatgacaaaataataggaaatgaaccagtggctcttgaaggtgatcggcatacatgcgatgatcagactcttgattccgaattctccgaagaggaaaaggtggagcaggtcataaaagataatggcgatatcgagcttgatcagcttttccagattgaaccggatgccaaaatatccggataccatcatgaacagcaggttggtattgtttgttaatgtgttgacaaaggaactgccaactaaattgcccgtggaaagatcatttgtataaggcccgatgctgtgccagaacacaacaaaaaagatgcagaggatacgaatcagctcaaagctggaatttctttgttttggcatggtgaaaataccctttcttcatttattttattgaatattcattatagcaatccagaaataatttgacaagttgttgttttcttaatatgattaagattggtattttataagataaaggagaagactatgaatcagttaaaaagcgcctttgaggttttcgacaaaaaacagaaacgaagtcttgtatatctgacatttatcatattcatcgactcatttgtagaattgctcggtgtgacggtaattctgccgtttatcaatgcggtgatcgcaccggaacagcttctgcagaataagttcgcagcgtgggcatatgatacgcttggcatgaagaacaccaatgagtttatcattgtcattgcagcgatgattattgccgtgtatattttaaaaaatatttttctggtgtatatgtacaatctgcagtataagttctcctattacggcaagaagcagatgcagaacacgctgatgcgctactatattggtcaggattatacctttttcctgaatctaaacagtgcggagctgatgcgcaatatcaataccgatccggagatgttctataccgcggtgctcaatgccttacagatggcatcggaactctgtgtcagcgcgatcatcgtcatctttttaatggtaacggatgtgacgatcacgctgggtgtggcagccagccttgcgatcatgatgctgatcctctccaaaggactcaaaaaaatactggaaggctatggaaatgacagaagaacctactctgcaagtatgatcaagtgcatgcagcaggcatttggcggtatcaaggagattaagattgcaaaccgcgaagagtttttcgagcgtgattttgagaaacagaatgagatctatacttatgttatcaaacagaactctttcttaagtgcactgccaaagccgatcattgaggcacttgccatcgcaggtctgatgggaatgattattgtcaagatcgcgatgggaaacacgaacaatgcgcactttatcgcagtgcttggtgtattcgcagtggcggcattcaagctgctgccttccgtcaataaaatttcttcctactatgcgtccattatccacaatggcgtcgtgatcgacaagatccgtgatgagtaccgtgatatagaggcgcaccgcgaggcacgtgccgaggcggaagcaagaaaagcagaggagatcccggtaaccctggagaaggaaatccgtgtggaacatatggagtttacttatccgaatgtggaggagccggtgctttccgatgtgaatgttacaatcccgaagaatgcgtcggtggcgttcattggaccgtccggagcaggaaagaccacgtttgtcgatctgatccttggtgttctgactccgcagaagggtgtcatcatgaccgatggtgtggatatccagaagggaatgcgcagctggcatgacaagatcggttatatcccgcagaccatctatatgcttgatgatacaatccgcaataacattgcatttggtgcaaatgaggacattgatgatgagcggatctgggaggcattaaagcaggcacagcttgacgatctggtacgtgagatggaggaaggtctggataccgtcatcggtgaggcgggtgtgcgcctttccggtggacagagacagagaatcggtatcgcgcgtgcactttaccgcagaccggaagttctggtgcttgacgaggcaacttctgcgcttgacaatgagacagaggcagctgttatggaagcaatcgacagcctgcagggcaagatgacgatgctgattattgcgcaccggctgtccacgatccgtaactgcaatattgtatataaggtagaaaatggtagcgtgacagtggatacacagcgccacaaccagtagaccggaggggatggaacgaacatgataatcatagaaccatgtgcaggactgggaaaccgcctgctggcactgacttcagcgtatgaattggcggagaagctgggaagggagctgcttgtcatctggaagagcgagataggctgccagatccggtcagaggagctgttcctgtttgatggggttaaggtgatcaatatcagtgagagtggatggaagcaggattttgccgggacactgcgcggcaatgccgtcaagaaaaaataccgtggcagcgcagaccggtttgtggagtgtgatgaggtagaggtctggaaaaaagagggtggatttgcgcgtgtggaacaggagattgcgaaaacgtcccggatctacatcaaatcctacacaaatctgtgcgagatcacgccggacagcttcaggttcttaacgccttccgctgcggtggaagcgcgtggcagagaagtgtttgcccagatcacaaaggagcggacggtgggggtacacatccgccgtaccgaccacacagatgcgatcgcaaacagcccgctggagttgtttaccgatcggatgaagcgcgagatagaggaaaaggatgccaatttttatgtgacgacggacgatgccagggtcatggacgagttaaagcaggcatttcccgcagagcgtctggtaatctacgagaataaggtacttgaccgtgattccagggagggcatacaggatgccctggtggatatgctgtgtctgtcaaagtgtagcaggatcataggaagctaccggagtacgttcagcctgatcccttcgatcatgggaaatattccgctagagatgatgataaaggattgagaaaatgaaaacgtgtacgatattaggaacagagattgccgtcacgacgatggaagagacggttcgctatatagaggaacacatggaggaactgcgcgggaaatatatctgcgtctcgaatgtgcacacgacggtaacggcatatgaggatgaaagctatcgcaaagtgcagaatggtgccgcatttgccctgccggatggaaaaccgctgtctctttattcaaaaaagcacggattcccggaggcggaacgtgtgaccggaccggatctgatgggagaactgttcgcgagagacaatgggctgactcactatttttacggggggagcgaggcgacgatcgggacactgcgtgagaagcttcccaaagaatatccacatcttaagattgcaggaatggtgtcgccgccgtaccgccctctgacgaaggaggaggatgcggcgcaggtggaggcaatgaatgcgtcgggagcagatatcatctggatcgggcttggcgcacccaagcaggagcgttacatgtttgagcaccagggattgacgcagggcgtcatggtcggtgtgggagccggatttgactactatgccgggacgatccggcgcgcgccgatgtggatgcagaagttgagcttagagtggttataccgtctgatgcaggatcccaagcgtctgttcaaacgttattttgtgacaaatttcaagttcctgcggctgacacttggaagggggaagaagagcagaggagagaaaaagtcatgacagaggcgaaggcaaagtaccaatacatggatgtggcacgggggctggcattgctgttggtcatgatctcacatgcgcacggactcagcagttttctgattttttactatatccagatctttttcatcatctcgggctatatttataagcctgggcggagttacggggacaatatccggcgcaaggcaaaacgccttcttgtgccttattttggttacagtgcactgctgtggtgcgcgtatgccctgatccgccgggatatgggagagatgaaacagtcgctgtttggcattttttattcgaggttctgcttgtacaaaaatgcaacgcacacagagaatgtctatctgttggatattgccaacggagcgatgtggtatctgactgcattttttgtgacctgcctgctgttttatctgatcgcagacaagtgccttgcaagtgcaaagacaatggcggtcacatcggtcgtgctcgttgccgtgacgatggcattaaacgaactgcccattcttcttccgtggagtatggatattgtgccggttgcggcactgctcatgctggtgggagcgtggatgcgcagatatgagttttttgagagaaaatggaatctactgtggatttttgtgacactggcagtctatgtgggaacggttgtattcaacggcagattaaatatgtccatccgcgagtatggacggtttgacagtttcagcgtacctttttttcttgtaatctcgctgaccggatcaaccttatgtatctggttttgtaaatggatcgggcacacgaaggtagggagcggtctggcatacattggcaatcatacgatcgagttgatgtgcctgcatatgttcggtcttgagatgtttgaggtaatcgcgtcgcatgtcatcccggtacaggaactgacaggagtggcggagtggatttatgtagcagtgcgcgttggcgcagcggtctgcggctccctgctgtttggtgtgggtgtgtcgtgggtcaaaaagaagagaggaaggtagcatggagaaaaaggaaagagattcaggtctggagcttttgcgcatcatcggattgttcctgatcttctggatgcatggggcgagcagttatgtaaataattcgctgagtgcctggctgtgtattgtgattgagacaatcggaaatgtcggggttccggtctttatcctgatttcaggatatttcgggatccggttcaaacctaaaaaactcctgcagctggatctgatgctgatcttttactgctggaccggtcttgcgctgcgctttgcgtggggagatgccgcagagtatggaatggaacagattctctcctatgtacttccggtcattggccgcaattcctggtattttacctgctactttgcactggcgattttaagtccgttcttaaacgaatttgtggaaaagctggagaaggagaccttccgcaggatgcttgtgctgatgttagtgatcttttcgggtatcacgacatttctctttttcgatatcacacaggatggcggaaagggaatcgtcaatatgaccctgttgtacctgatcgggcggtatatccgcctgtatcaggataaaaaggtgtacagccggaaaaaactcatcacggcgtatgttgccatcatggcagtctgtattgcattaaacggggcactgtatgtggtgagtggtacggtgcagaatcggttttcgcgtgacaatacgctctttacgatcgcagcttcggtgtgcctgttcctgctttttaaggatctgcattttcgcagtaaggtggtcaaccgtctggcaacgcatgttccggcggtctttacgatggagtggacgctccgcggagtggtcacggcgtacatgttcgactatctggcgtggagggagagcaactggcatgagctgatcctctttggggtatgcttcctgctgcttgccatgggaaccgtgatcgatgaactgcgtgtactcctgctcgggcgggcagaggaaaagcttgcagatctggaataccggggacttaccaccgtctgcggtactctgaagcggtgcatccttcgatttttttaaaaactttattaaagtaactggcgtcatcaatgccacagtgctgtgcgatggtttcaatggaatcgttgctgtaacggagcagctctttggcattggtgattttttttgtcagcagatactggatgatcgttgttccgaattcttttttgaactccctggaaagatagtacttgctgatatagaactggtcggcaagctgatcgagggagatattttcggtatagtgttcgttgagatagcgaagaatatccttaagcttgacggacagcggggagtcatcggcggactcgcgtggcgcatctgtgcataaggtggtgaggatggatacgatctgtgcggcagtcagaaggtcggcatcgtccgtcttttcttcatgcagcgtaattacgttctggattgtggaggtgagttctgcgaggtggctgcttttaaaatgccagtcgtgctgctcgcggaaacagctgtagtatgcggctgcgtttggaccgtaaaaatggatccacagaagctcccaggggtccgcctcactgctgatgtgggtgtattcgccactgcaatctaaaaaaaagcagtcgccggcacgggcagcgacgcgggtcagaggatgtttggcgtcctgggggctgtcggatgcaggaaaaaggtgggagcctgcggtatcccggtaggagacactgccgctgccggagagtacgatcagaaagaggtaggaggagagaccgctccgccggcttaagtgcggccgcagactttttaagtaaccggcctcctggatgtagagaaagttgcttttaataaaagaagaaggggtattgatgacacgtctggtgttggtgacctcggaggtcttatatttttcaaaaaaagagtcccgcatctgtattctcctaatttttgtgtatagcaatataatactatttttgggcaagatattcaatggaaaaaaaacgtggattagattattcttagtaacggctttcaacgcgcatattagcaaaataatcatagaacaaagaaaaaggagaatctagatgagtaaaaaagcattgatcacaggtgtgaccggacaggacggaagctaccttgcagagtttttgttagagaaggggtatgaggtacatggtatggtacgccgttcttccacagagaagagagagcgtatcgaccatttggagagcaacccgaacttccatgtacactacggcgatctgtccgattccatgagcatcatgcgcttagtgggcatgattaagccggatgagatctacaacctggcagcacagagccatgtaggtgtcagctttgatgtgccggaatacacggcagatgtagttgcaactggtgtgctccgcgttttagaggcagtccgtctctgtggtctggagaagacctgccgtatctatcaggcatccacatccgagttatacggaaaggtagaggaagttccgcagcgcgagacgacaccgttccacccgtacagcccgtatgcagtggcaaagcagtatggctactggatcgtaaaggagtaccgcgaagcatacaacatgttctgctgcagcggtatcttgttcaatcatgagtccgagcgccgcggtgagacatttgttaccagaaagatttctctggctgcagcaagaatcgcgcagggcaagcaggacaagctgtatcttggcaatctgtcttccttacgtgactggggttatgcaaaggattatgtagagtgcatgtggctgatcttacagcatgagaagccggaggatttcgtgatcgcgaccggtgtacagcattccgtaagagaattctgtgagtatgcattccgcgaggctggcattgaactggagttccagggagagggcatggatgaggtcggtatcgacaaggcaaccggcaaggtagtcattgaggtatccaaggagttctaccgcccgacggacgttgtcaacctgtggggagatccaaccaaggcaaagaccgagcttggctggaatccgaccaagacaacattcgaggagctggtaaagatcatggtaaagcatgacatggagcttgtggcaaaagaaaactaaaacaaatgtatgacgatacagtatttggcgtgccatggcaggattctgccggggcacgccaagttgtggtaaaaaggagagaaagattatgatggaaaaagatgcaaaaatatacgtggcagggcacagaggaatggttggctcggcgatcgtgcgccagcttgagaaggaaggctatcacaacatcattacccggacacacaaggagttgaacctctgccgccaggatgatgtggaggaattttttgcaaaagagaagccggagtatgtcttccttgcagcggcaaaggttggcggtatcatggcgaacagcgaagctcttgccgattttatgtatgagaatatgacactggagatgaacgtgatccatgaggcatggaaaaatggctgcaagaagctgatgtttctcggatcttcctgcatttacccgcgtatggccccgcagccgatgaaggagagctgtcttctgaccggagaactggagaagaccaacgaggcatatgcactggcaaagatcagcggtttaaagtattgtgagtttttgaataagcagtacggcaccgattatatttctgttatgccgaccaacctctacggaccgaacgataactaccatccggagcacagccatgtccttccggcgctgatccgccgtttccatgaggcgaaggtggcaggagccaaagaagtaacctgctggggaaccggaacgccgctgcgtgagtttttgtatgtggatgatcttgcagatgcttgtgtattcctgatgaacaactacagtggtgatgagacggtcaaccttggaaccggcaaagaacttacaatcaaagaactcacagagcttgttgcaaaagtgatcggttataccggagagatcaagtgggatccgagcaagccggacggaacaccgagaaagcttctcgatgtcagcaagttagagagcctcggctggaaatacaagacggagcttgaggatggaatccgccttgcatacgatgatttcctgaataatccaatgagagccgagcgctagaggggagaaccatatgtatatagtattgttatcgggcggctccggaaagcgtctgtggccattgtccaacgatttatgttccaaacagtatatcaagctgatgaatcatgataatcaaaaggagacggcagaaaagtgttcgatgctgcagcgtgtgtttggccagcttaagaccgcgggactttccgacaacacgatcgtctgcgcgagcagtgcacaggtggagctgattgagagccagcttgacggggctgcagaggtggcagttgagccgatgcgccgtgacactttcccggctgttatgttatcctgtgcttatcttttgtctaaaaagggagcgaaggaggatgacgtcgttgcatttcttccggtcgacccgtacacgacaggagagttttttgaccggatcaagcgtctgggagagtatattgcatccacagagaatacgattggactgctcggcggtgtgccgacgtatccatcaaccaaatacggttatatcgtgccggagaagagtgggcaggagctgcttaaggtcgaaggcttccgtgagaagccggatgaggcaactgcggagaaactggtcgcagacggggcgctctggaactgtggtgtgttttgtttccagttatccatggcagccggctggcttacaaagtatggtgttggcacggattatgaccagatggtcactgattatgagaagcttccgaagaaaagttttgactacgaggtgttagagcactgggagcgcattgttgcgattaaatatgcagatctgtggaaggatctgggtacatggaatacactgaccgaggaaatgccggagaacagcatcggtgatgtgacctgggatgatacctgcgagaacagccatgccatcaatgtgctcggcgtgccgatggttgtgatgggagcgaaaaatatggtgatcgcagcatcccatgatggtattctggtggcggacaagcatcagagctcctatatcaaggattgtctgacgaacattgcggacacttcaaagtatgaggagcgccgctggggtacgatcaagacgatcgacagtgatgaggatgacggcattaagagtgtgacaaggcgcatcaaggttgttgcaggcaagacgacaccggagcacaggcatctgtcccacacagagacaatcacggttctctccggaatgggaaaattgatcttagaaggtgtggaagtagatctgatggcaggagcgacagtcagcattgcagccggcaaacggcatgcaatcaaggctatgggttcggatctgcgctgtattgaggtgtcgatcggtacggacgagaagagtaccttggacgatgagattataggataaggacggcagagcgatgaatatattactgacatccgcgggaagacgcggttatcttgtcgaatacttcaagaaagcactagaggggatcggggaagtgcatgtgggaaacagcacaccggtttccccgagcttttactatgcagatcatgcagttgtgacccctctgatttacgatgaggcatatattccgtttttgctggattactgcaaaaaaaaccacattgatgcggtactgtccttgtttgacgtggatctgtatatgctggcacagcacagggaagagtttgcaaaagaaggcatcaaggtgattgtgtccgcaccggaggtgatccgtatctgcaacgataaatgggagacataccagttctgcaggaaaaacggttttctgacaccgaagacctggctgcatctttcggatgtgaaagctgcactggaggcgggggagatttcctatccggtcatcatcaagccgcgctggggcatgggatcgatcgccatctatcaggcagagaatgcagaggaactcgaggtattgaccaaaaaggtcacgcgggagattttccgctcctatctccggtatgaatcagcgttcgatgaggaggaatgtgtcctgttccaggagatgatccatggacaggagcacggactggatgtgatccacgatctggacggagcatggcagctgacggtcgtgcgtgagaagatcgccatgcgttcgggcgagacggactgtgcgagagtgctgtcggatgagaggattgcatcggtaggaactgctgtcggcaaggcgctgggacatatcggaaatctggatatggatgtgtttgtgaccgaagatgcggtctatgtacttgaactcaacgcgagatttggcgggggatatccgttttcccatctggcaggcgttaatctgccgaaggcgattataaagtggctttcgggtgaggcacttacagatgaacttgtggtaaagaaaacaggtctttatgcacagaaggatatccgaatgatcgatatcacatcgtgtgtaaaagaagacggaaagtaaaagtatggaaaaagaaagaaaatatcaacagtcctatgtgacaccctgctatgagatcaatcttgagcagtttcacgaaaattgtgatgctgtgatgcagccgtttgaaaaagcatgggatggaaatgtggcatacggttactcggtaaagacaaaccatcacgaggcactgatgcgctatgccgcggatcatctgggatggtatattgagacggtttctgtgaatgaatacgagcaggccagacaactggtgcctgcggagcggatcatattcaatggaccgtgcaagcaggaacgtctgctcacagtctatgagcagggaggaatcctgaatctggataaccccacagaagtagaacagctgtgtgagacggtaagaaacggagctgttccatcagaacacacacaggtgggacttcggatcaattttgatctggaggcacagtgcccggatgagacaaccgctggtacagaggtcagtcgttttggcatctgctatgaaaatggtgatcttaagcgtgccatagaccagcttgaggaggcgggtattgccattgacggcatccatctgcacaccagcacaaagaccagaagcacccgtgtttttgcggcattggcggggatggcggtgaagatccgggaggaatatggactgtccttaagttatgtggatatgggaggcggctattttggcggacagaaggtcaccggaaagccgacgatggaagagtacgcggcgtgtatctgtggagaactgagaaaaggtttttcgccggaaaaaacgacgctgatcttagagccgggtgcatccgtgattgcgacgtgtgtcaattatatcagccgtgtcatcggcaccagagatgtgcgtggggtacgtgcagtgacgcttgacggcagcctgctccatatcaatccgtttatgagcagcaggattccatcgtatgaatggctgggagacggggacaggcagatggaggaagtacagatcgtcagcggctgtacctgcatggaaaatgaccgctttttaaaactgatcgagaaaaaacgcatagagacgggggatgtttttgtgttccactatgcgggggcttacacgatggcattcaacagtgagttcatcttgcagccgccgcgcgtctacgtggtaaacgaggatagataaaagttgaaggataaaatgttatcagtaatcattcctgcctacaacgaggaagcgatgattccgatcaccgcaaagtgtgtggcaggattgttggaaaaagaaaaaattgtatacgagctggtctttgtcaacgatggatcccgggatgcaacctgggagaagatccggaaggcttcggacgacaacccatatgtgagggggatctgtttttccaggaattttggaaaagagtcagcgatgatggcagggcttgcctacgcgaaaggtgcggcatgtgtcatcatagactgtgacctgcagcatccgccggagaagatcattgagatgtaccacctgtgggagaacggttacaaagtcgtggagggagtaaaactctcgcgtggcagggagagttttctccataaatgggcggcaggaatgttctatgcgctcatcagtgcggcgacgaagatcgacatgcgcaatgcctcggattttaagctgatggatagagaggtggtggatgccatcttgaagatgccggaaaaacagtttttcttccgggcgatttcttcctgggtgggctttaaaagcacatcggtggagtttgaggtgcaggagcggcagcagggagaatccaagtggtcggtaaaatcgctgatccgctatgcggtcacgaatatcacgtccttttcgtcagttccgctgcagttagtgacatggagcggctttctgtttttcctgttcgcactggtgattgggatccagacgctcgtgcggtttatcatgcacgattcgctggaaggatttacaaccgtcatcatgctccagcttattacgagcagcatcctcatgatcgcagtaggcatcatagggtactatattgcgaagatctatgatgaggtcaaggatcgcccgcgttatatcgtggaggaagagacgggagaaaataagacggatggataggataaaagaactgatgaaaaaataccgtgaactcatcacatatgtgttctggggcgggatgacgacagttgtaaactacatcgtctattttgcgtgcaccaagcttttgggtattgaatatctgatcagcaatgtcatcgcctgggttgtcgcagtcatttttgcattctgggtcaacaaaatctatgtgtttcaatcctatgggcgggacaagaaaacgatgctccatgagtttggtacctttgtatcggcgcgcgtgctctccggtgtcttagagaccggcatgatggcactgtttgtatccgtcatgcattttaatgattcggtcatcaagattattgctagtgtactggttgtcatcatcaactatgtgctcagcaagctggtcatttttaagaaacagaaggaggaacagaaatgaaagtggcattcagtacgccggatgggtttgtgagggaaatctctgcaagaattccaagaccggttaagtctgcatttttcagtgcagtcatcattgggttgatgacacatttatatcagtttaccaataaactttataattatgatgaactgattaatacgccgaatggttatggaaccggagcagaatccgggcgctggtttttgaaaattatcggagattttactggggcacagtttggaaattattccctgccactggtcaacggtatgatatcggtactgttcctcgccgtttcggcggctctcatcactgggatgttccgtgtgcagagtacctttctggcggcagcagtgggtggattttttatttcctttcctgctgttaccagtacgtttttgttcatgtatacggcaccgttttatgctttttctgtattcttaagtgtactggctgcgtttcttatggtgcgtttttcggggaagatcgttttaaatattgtatcggttgtcctgatcgcgtgttcacttggcatttatcaggcatattttgcgaacacgacaagtcttcttgtaatgaatatgattctgctctgtgcgttttccggggaagataagaaatggaaggatatcctttttacagcgatccgctatgtcatcgttctggcggcaggcatgatcctgtattttgtgcttcataaaacgctgctccatgtgtggggactctctatgacttcctatcaggggctggattccatgggacagacgacggtaaaagatcttcttgacggattaaagagctgttatcgggattttatcaatttgttccgtggcgatgtcatgtgcttaaacccgaccaaatatgtaaaaaaatgttattttcttattatggcggcactgggcgtaagtacgctgggacttctgtttggtcagaagggctgcaaggtcaagaaagtatttctggtgttaggttatctggtatttccagtagcggtttatctgatctatctgatgacgccaaacggatgggtctacacactgatggcatacccggctgtttttgtgacgatcttcatggtgatctgggcagaccggtatcaggcggcgtttgatacaaagcagattgcagcgaagggaatgcagtggattgcggcagtaacatcggtcatcatgattggagtgtatatctggtatggcaacggatgttatatgtcacttgagtatacaaagtatcatgatatgtcgtattttcagacgatggtgacacagatcaagagcctggatggctacaatgatgatctggcactggcgctcattgggaatacgatcgatgataacaccaacaatacgggaagtcttgtgagcgggacgtttggacttggtggcaagctggattccaatatcagcgcttactccagaaattacatcatcatcaagtatcttggtttttcgccgcgtttttgcggatatgaggagatcaaggagttgatggaaaatgaggaagtgaaggaaatgccctgctatccggatgatggcgcgattcggatcatagacggtgtggtggttgtcaaactgacggattcataacagcccggcatatctgtacagaaattataagaataggagaaaagatgggtctggaaaaaacgatacagaagaaaaggaaaatcgtatacctggagctgctgcgcatcatcgcgtgcttctgtgtaatcatcaatcataccaacagcgggatttttctgtcgcgcacgccggattctaaaatatggtgggtttcgcttacttacttttttgtcagtaaaacggcggtcccgatctttttgatgatctccggcgtcctgctgctcgggcatgtggatacataccggaaatggtcgtcacgcatgctgcatatttttctggatattctgatattttcatttttttactatgtgtggagtatgtatacagcagaccgatcggtcaacctgattgaatatctgaaactgatctggcaaagaaacgtgaccaatgcatactggtacttatatctgtatttgggaatacttctgatgctgccattgttccagagactttctgtgaacatgggaaagagggagtatgagttgctgattctggtttgtgcagtgtttatgagcacgatgccgatcgtgattcactatatgccgggagcagcgttttcctcttatttctgtgatccgtttttctcggaatttgtgggaattttcttcctgggctattatattcacaattatgtgccggtgaaaaaagaatatgcgctggcagcagtactggtctttggcatggatattttactgcaggtattgctcacttaccgggaatatcaggttgacccacagcagtatctgttttttgacgaacgtacattcattacggtggtcacagcagcggcaacactcttttacctgggacgctgcatggaggcggtgctaaccagtgagtggttctggaaagtggttggattttttggcggatgctcttttggcatttatctgctttctgattttttcctggacagttattatggaatctatggaaacttgtcagaaaggatgaatccgatgatcgctgtgtttttttatgagtgtttgattttcctcacgggagcggcggtcacagcggtcttaaaaaagattccgtatataaaaaagcttctatagacagttttcagtaaagttatgcttgcctttttgctaaaattatgataaaaatggaaaagatacggaagtatcagaaaaaaagattgaatttgatacgaatatggtttatactataaccgtagaaaggggaatgattttatggatacgaacgatatttcagcatgcgaaaagctcgtgatgaaggtcatttgggattctacagaagaattggcattgcaggaagtcatggatggagtcaatcatgagaacggcaagaactggaagccgcagactgtttccacatttttatcccgtctggtaaagaaaggctttctgaatatgtaccgcaagggcagatactgctattatcagccgcttgtcagcaaggaagacttctggcgcgcgacgatggaagagagtgcaaagttctttacgaagggagatctcggagaactggcatgctgtctgtgtgatgacatgctggatgcaaaggacatcgagaaactaaagaaaaagctgaatgaacatagctaatcagattttatttgcagtggtaattacctctgtcacgggaacggcagcgtacggactctggcggctgcttatgaacagccgcttttgtacgaagccgcaatttgtatatctgacgctttttctggtctgcctgttgtacctgattccattggattatggatggatgcagatgacgattcacggttatctgcagaaggaaggtatctggcagatcaatttttctttaacgggatttttatggattcttgcgttctttgctgcagtctgctggcttgccctcatggcaaagggaatcacagagtttgcaggcagccttcgcgggatgaagcggattcagatgcgtgatattccggaggaagagggagccgtgcgggaagagttcgcacgtgtgaagaaaaagcttggcatccggtcgaacatccgtctgtaccggaatgaccgtatcaccagtccgatgtttgccggtattttccggtgccgggtggtgcttccggatattgcctacgacagaaagcatctgagcgtgatctttcatcacgagctgatgcattacaagagccatgacccgtttatcagattatgcggtatgtgtgtgactgcagtgcaccacatcaacccgctgacggggaacctgatggcactgttggacgagtggagcgagatttactgcgatgcacgtgcgattgcagccatcagcgatgaaatggatgcagggtgttattttgaaatgattatagagagtgtgaagcacagtcctgtgaccgatgagaattatattttttctatgctttatgagaaccagagaagactggaaaggagaattgagtatatgggaaaatataatggaaaagcagcatcgagactggcaagtatgtgttttgcggcggcgtttgtgctgatgagtgtgacaccgatctatgcggcgggcagcgaggctgcggacgtacacgatgatatctaccagaatgtggaggctgtgacggcagatggcagcgaggagaacgtgctcgaggagcagcagatcttaggtgtgatggaccgcacttacgataccttggagtatgcgtatccggagcttgaagtcatcagcccgctgctgagcgcgaatgagatggcgtcctttaactggagcgtgtctccgggcacacgtatggtgagcaatcagttctgggtgaccaagggacagacgatccatatggcggcaaccgcgtcaccgtcgagcagcacgttctggatcggcattatggacggactgaacaatgcgcgctacgtggagggatctggcagcctgtctcacgattttgcgatcacgagcagtggacattaccgcgtcttcgtgcagaacaggagcagcgcacagattaacgcggtgggaagttattacttcgattagtatcagcgtaccgcaatcagtgcatagcgatcagcgcatcggaagaggtgcatcggaagatgcgaaagcggtaaagacaacaaaagcaataaaaaagaagaggcattccgcctcttgcttttcagacaaacaaactacatgattagatataattccacggttgcagtgcatttcacattatgattagatcatttcaaggtaacagtattcggggcggtgctaaaatcaagcaccgtctttccttttgcgagcaggtcggatttgagtgtgctcgccggaaagtcggcgttgtcggtgatggaggaaggcgcgtcgataaaatagacggaggcgccggctgcgtcgtagaattcctccgagaaagaccagtttccgtggtggccggtctgcacgtaatcgcaggcgagctggtctttgcatgcggcaagcagggaatcattcatatcgtatttgatgtccgaacaaaagagcatgctgctgtttgcgctgcttacttttaagaggagggaagcattgttctggtaatctttctcatctccgacattctgcagaaccgtgtcgtcataggcatttaggacggagaacgtcagaccgcagatggagaggacgtcgccgcggtgcaggtgcgtcacgttggaggcatcccgggtgagcgtgtggtaggtctccatcactgtaatgtcatcgtacggctctccggccgcttcgataaagtcatagtcaaaaccgttgtcgtagacggcgtcgatcgtgatgccgtctggtgaggcgtagatctgattgaatgcgccggcgtgatcctgatgcggatgtgagagaatccaggcgttgacatggttcccgtgggcggcgatgacctcgcgtacggcggaggcgttgtctgcccagcccccgtcgatgatgatgagggtggtatcgttcgtgatggtgtaaaaggttccctgcacaccggttgcatccgcgtattgcgtcaccagatattccgtggcgggatcgggggtgtagccggtggaatcttttttggattccacgagtgtatgatgggagcatgccgcgagaactacggcaaaaagaacgacaatgacagtggaaaaaaggtgtttaaaacgcatcataaggactcctttgagttgatcggtttattctttgcattctacattaacagagaacaaaaggaatgtaaaggcgtggtaacaacttgacgcaaaacgtcggaattgttatagtggaatacgaaatcaaagagattgaccgaggagtcaatggcgagagaggacggaccatggatacacataaattttttgtggaaaagatgcggttccatctgaaggaacaggacacgctggtctttgtcgggtggttttttgatgggagtacgaaggaacattccatcaaggcatatctggacaacagagagcttccgcttacggtacaggtgaatcgcggtgcggaggtccgacagaaatatatccgcagcatcaatgagatcgaggaggaagtggtaggcatcataaagcttccgccggactggcgcaatggccgccgggtgacattgatggctgcttacagggaagaatataagaaatcttatgccatctcgacagcaaagcttggcagactggagaatgaagtcagctactacgtggaaaactgtcacagggaggggagccagattacggtcactggctggtgcatgtcggcgggggatatcaagcttgaacttctcgacggcagcagacagccgatttccgagaaggtggagcactattaccgcaaggatcttctttctgtttttccggaatgtgataaggaggcaaagcctggctttctggtgcagggaactgcagcgggagggcagagtggtccgttttatctggagatgcggggggcgaagaagcattcgagaaccagactcacgaagtgggacgagggcacaaagctgcagtatgtaatcgaaaaagccggggataccgtccgctatctggagcgcaacggaatctctgcaactgcttataagattaagaacaagctgatgcacaaagagggcaatacctatgagaactggcgggcgaagtatctcccgtcaccggaagaactgcagcgccagagagaggatgtgtttgatgcgggaccgttgttttcgctggtcgtgccgctctataagacgaagccgcagtatctgcgggagatgattgattccgtgacggcgcagacttacggaaactgggagctgtgtatggcgcttgccgcatccggggaagaggatgcagcactgatctccattctggaggagtatgccgggcgtgatgcgcggattcactatcaggtgctgccggagaacggaggaatcgcggaaaatacgaacgccgcgtttgcaatggcttccggagactatcttgtaccggtggatcatgacgatctcgtgccggaaaatgcgctatacgaatttgcgtcggcgatccgcagggatgacgcgattgatatgctctactccgatgaggacaaggtcagcatggacggcagacacttttttgagccgcatttcaaaccggactttgatctggatctgctgtgcagcgtgaattatatctgccacctgctcgcggtgcgaaaagatgtggcggaacgtgcggggagctaccagagcgcgtttgacggcgcgcaggatctggactttatcctaagatgcagcgagcaggccaaaaagatttatcatgtgccaaagattttgtaccattggcgctgtcatatggactcgaccgcttccaatccggagagcaagctctatgcgtttgaggcgggacggcgcgccatcgaggagcattaccgcagactgggaataccggcgcgcgtggaaaatgcatcgttctacggaatgtaccgcacggtctacgagtggaaagaggaacctctggtatctattatcataccaaacaaggatcacgcggaggatttaaagctgtgtctggattccatttttacaaaatccgactaccggaattttgaggttgtgattgtggaaaataacagtaccgagccggagacgtttgcttattataaggaacttgaggcggggcatgaaaatgtcaaggtggtgtactacgagggcggctttaactactcaaagatcaataattttggcgcagcggcatgcaggggagattatttcctgctgctgaacaatgatacggagatgatcgatgggggctgtatccgggagatgctcggatattgtatgagagaggatgtcggaattgtaggtgccaagcttttatatgcggacgatacgatccagcatgccggtgtgattttaggttttggcggcacggcgggacatgctttcattggaaaatccagatacgatacgggatattttggcagaattctgtgcgcgcaggattattccgcggttaccgcagcgtgcatgatgacgaagcgtgaggcgtttgaggcggtcgggggaatgaccgaggaactcgccgtggcgttcaatgatgtggactactgcctgaaagtaagaaagcacggatggctcgtcgtgtacgatccctacgcggaaatgcaccactacgaatcgaagtcgagaggctatgaggattccccggaaaaagtcgagcgctttaacggcgaggtggagattctgctttcgcgttggagagatcagattgagcagggagatccctactacaatccgaatctgacactggacaattctgatttttcgctgcgcagataacgcgggggacggcgaaaacaggtgaataaaacaaaaagacagctggtacgagacagaaaagaggagattccggttctatgatgaaggtatatatatgtccgtcctgcggctggatgcgcgtagtgtccagacgcaaggatgtggaatgctacaagtgcagtgagccgcagatggttcttgcaaaaatggatttcggtaagtacacggaaatgtcagaagaggaaaggaaagattattccgatggatggctttacatccatcagaagaagcattgagcatatgaagattacagtgcagaaggttatcaaaggggtgcgttatctgaagcattacggagtgaaggagtttttcatccggctgcaggagaagatggaagcggaaaatgtgccgtatgagccatggtatgagcatcacaaggcgacggaggagacgctgcgccgtcagcggaagcagtctgctgcgtggaagggagcaccccgcgtcagcatcgtggtgccgctctattgtaccaatgagacattcctgcgggagatgatcggttcggtgcaggtgcagagctacgaaaactgggaactctgtctggcagacggaagcccgaaggaagaggcggtgcgtcttgaggcggttgtgcgggaatgtgccggagaggatgcacgcatctgttaccgcagactggaaaaaaatcttggaattgccggcaataccaatgcggcgattgcaatggcgcacggggagtggattgcacttttagatcatgacgatctgctggcgccggacgcactgtatgagaccgtgcatctgattctgcggggaccgaaggatgagaccggagttgccgcgaccggttttcacaaagccggtgcgcagtatgacatgatctacacggatgaagacaaggtggacatggatggaaaaacgcatttccagccgcactttaagccagacatcaatatcgatctgctccgatccaacaactatatcacgcactttaccatgatgcggaaaacgcttctggagaaagccggcatgatccgtgaggagtatgacggtgcgcaggattacgacctgtttctgcgctgcgtggaatgcgcagaggccatcggacatgtgccgcgggtgctctaccactggcgctgtcacacggaatcgacgtcggaaaacccgttttccaagcagtatgcggtggatgcgggacggcgcgcgctcgaggatcatctgaagcgtcaggggattgcgggggaagtgacggcgacaaaggatatgggcttttacacggtgcgctatccttacagcggcaatccgctggtctcgatcgtgataccgagcagggatgaagtggagacgttaaaaaaatgtcttgcagccattcaaaaaacgcattatgcaaattatgaagtcattgtggtggagaataacagcgctccggagacatttgacttttaccgctcgatcacatccgaagaggtgaaagagggcgaagcggtgtgctatgagggaaccttatccggcggacagcggatctgcgtggcagtctggaaggaagggtttaattattcggcgcttaacaatttcggcgtctctcatgcaaagggcgaatatctggtgcttatgaacaatgacatcgagatgattaccgaagactggctcgaagagatgcttggcacctgccagcgcagggaggtcggtgtcgtgggagcgaagctgtattatccggatgataccgtgcagcatgcgggaatcgttgtcggaatcggcggcaatgcgcgtggcatcgggcagaacatgtttatgggactgcagagagcgcgcagcggatacctgcacaaggcgtcgcttgcgatggattactcggcggtcacggcggcatgcctgatggtaaagcggagtatctacgaggcggtgggcggatttgaggaaaagcttgccgtggcgttcaatgatgtggacttctgtctgaaagtccgcaaagagggttaccttgtggtgtaccagccgcgggtggaagcctatcactacgaatccaaatcgcgcggaagcgaggattccccggaaaaagtggcgcgcttcggacgggagatcgaatatatgcggaatcactggatcggcattttaaagaacggtgatccctactacaatccaaacttttcaacggtatatccgaattatgcgctgagagattatcattaagcggaggtattacatggcgagtcagccggaagttacggtgattattccgaattacaacggaaggaagcttttggaaaattgtatacagaccttagagagacagacctgcacggattttaagcttctggtggtggacaacggatcggacgacggcagtacagaggtgacctccagcctggatcttacgatgcttgcgctaaaggagaatacgggcttctgcggagcggtgaacgagggcatccggcgcgcggatacgccgtatgtgatcctgctcaacaacgacacggaggttctgccggaattcgtggaggagctgctggctgcgatcaaaaaatcggaccgcatcttttccgcgggggcaatgatgattgattatcacgacagagagcgcatcgataatgccggcgactattacacggcattcggatgggcggtggcgcgcggaaaaggaaaaccgctggcggattttaacagaccgtgccgtgtgttttcctgttgcggcggcgctgtcatataccgcaccgggctgctgcgtgaaatggggccgtttgacgagcgccattttgcatatctcgaggatgtcgatatggggtatcgggcaaaaatccacggatacatcaactgctatgcgcccggagcgcgggtgtatcatgtggggagcgctactacaggaacacgttataatgagaaaaaggtgttcctcgcggcgcgcaattcgatgtatctgatctacaagaacatgccatttttacagctgctgatcaacctgccgctgatcctttcaggtattctcatcaagagtctgtttttcctgaaaaaggggtttgcgggagaatatttaaggggaatcggtgccgggattaccgggtgccgcggatgcaaaaaagtgcggttctcatggaaaaatctggggaattacgcgctcatacagctggctttgtggggcaatgtgatccggattctggcaggaagataaatttgatcgtcaaacaaatctttaaaaaatattaagaaaatgttacagaatgtttgcgaaaaaggcgttgtgcttttatggaaattattgtatcattgatgttatatggtagttagaattcgcaaaaggatagcaatatgataaaagacaatcagcagtactttaataagctgcatgtactgatcgatgccttggttatcatcgtatcgtatgtgtttgcatggtggctgaagttcctgagcggtattctggatcatgaagtcggcgtactctcatttgagttctatatgagggcgctgctgctcattgttccggtgtatattttgttgtattatgcgttcaatctgtacacgtccaagcgcgtgcaggggagacggctggagttttccaacattgtgatggcgaatacggttggactgctgctgatgtttgcggctctctttaccctgacgtcttacaatccgcagtatcgcaacttttcacgggagatgcttttctatttctacgtgaccaatattgtgatggaagagattgtccgccttttgatccgcagatttctgcgaagtattcgcagaaggggatacaatttaaagcacattctgctcgtcggctattcaagagcggcagagcagtatatcgacagaattcagcagaatccgcagtggggatacaatgtgcgaggggtattggatgacaatattgccagaggcatctcctataagggagtgaaggtcatcggcagtattggtaatctcaactacatcctgccgcagaacagtctcgatgagattgcaatcaccctcggactggaagaatattataagctggaaaaaatagttgcggagtgtgagaagtccggcgtgcacaccaagttcattccggattacggcaacatcatacctacgagaccttacacggaggatcttctgggtctccccgtgatcaatatccgctatgtgccgctgtccaacacgttcaacgcatttgtgaagcgctgtatggatgtggtgggatcgattgtgtgtatcatcctcttttcaccggtgatgctgctgtcggcaatccttgtcaaggcgacatcgaagggaccgctgatctttgcacaggagagagtggggctgcacaataagccgtttcagatgtacaagttccgcaccatgtatgtgcagacggaggaggaagaacagaaaggctggacgaagaagaacgatccgcgtgtcacaggagtcggaaagttcttgcgcaagacaagcctggacgaattcccacagttatttaatgtgctgaagggcgatatgagtctggtgggaccaagacccgagcgtccgcagtatgtagagaaattccgggaagagatcccgagatatatgatcaagcatcaggtgcgtccgggaatgaccggctgggctcaggtcaacggataccgtggagacacgtcgatccgcaagcgcattgagcatgatctgtactacatcgagaactggacactagggctggatgtcaagattctgttcctcacggttttcaagggatttatcaataaaaatgcatattaggagaaaaatttatgagtagtagtggcaacagcagaaatggggcacatagcagcaacggggcgcacagcagcaaccggacacagacaggcggcagcggacatccgcagaagaagccgctgacaaaagcacagaaggcagcgatccgcaagaagaagcgtcagaagaagattattctcgttgtggttgagatcctggtacttctgcttctggcagttgtattgtttgcggtagtgaagctctccaagatccagaaagatacttctttcaatgagagtgatctggaagttaacgagggaatttcctcagaatcccagcagatcatgaaggggtatacgacgatagcgctgttcggactggacaaccgttccaacggcaacttatccaagggtaacagcgacgtgattatgattgcgagcatcaacaacgatacacatgaggtgaagctggtatctgtgtacagagattcctatctcgacatcggcaacagcacctaccggaaatgtaatgcagcctatgcgaacggcggaccggagcaggcgatctccatgttaaatacgaaccttgatttaaatattacggattatgtgaccgtggactttaatgcggtggtagagtgtgtggatcttctcggcggtgttgagatgaccgtaaccgatgaggaagcggtgctgatgcacggctacatggatgagatctccaagctgaccaagaagaaatccaagtatctgccgggagccggcacctacacaatggatggtgtacaggcatgtgcattcgcgcgtatccgttatacggccggtgatgactataagcgtaccgagcgtcagagagcagtgctcacggcgatgatccagaaggcgcagaaggccgatctcaagacgatcaacagcctgattgacgaggtattcggcgatattaagacaagctacagtaacaccgacctgattgcacttgcatcccaggtattcaattacagccttggcgagacgaccggattcccgtttgagaagaatacggtcacgctcggttccaagggaagtgtggtagtaccgtgtgatctgaaatccaacgtcattcagctgcatcagttcctgtacgatgatacggaatatgagccgacagacacggtaaagagcaacagtgaaaagattatcagtgataccggattccaccagggagatggctattgatgcgtgtagatatcataattccgacttacaaaccggatgacactttttgtctgctcctgcaaaaattgcaggagcagacctttgttatacatgaacttattctggttaataccgaggaagcactgtggaatgaggctgtacggaagtatccgatcgaacagattcggaaggagcttccgttttctagccgcatttttcacatgaccagagagaactttgaccacggcggtgccaggaatatgggagcggggtattccgaagcggatattctgatattcatgacacaggatgcggtgccggcagacgaaaggctggtggaacatctggtgcatgcgctcacatccggtgcgcacggtccggggactccagccaaaggtgcggttgcggtcgcgtatgcaaggcagctcccgcgggaggactgcggcatcatcgagcgctataccagacagtttaattatcccgatgagggatgcgtcaagagccgtgaggacataccgcggcttggcattaagacttttttctgctcggacgtgtgcgctgcataccgcagggatctgtttgagcagctcggcggatttgaatcgccggttatttttaacgaggatatgttttttgcggcgcatgcagtgcaggaaggatacaaggttgcgtatgcggcggacgccgaggtggttcattcgcacaactattcggtgaagcagcagtttcaccgcaattttgatctggcggtgtcccagacggcacatccggagatctttgagcaggtcagctcggaggcggagggcatgcgtctggtgaaaaatacgatgggttatctgtgtaagattcacaagccgtatctgatctggaagttagggtggcagtgtgtcggcaggtacgccggctattttctgggaaaacgctatcagaagcttggcagaagacagatcttgaagtgtaccatgagtccgtattactggaagcggatatggtcagaaaagtagggagcagaaaatgagtaacatactatatatcgtagtaccctgctataatgagcaggaggtacttccggagacatccaaaagactgcgggaaaaagtgcagacattacgtcagggcggcaaaatcgacgcggacagccggattctgtttgtgaatgacggatcgaaagacgcgacgtgggagatgattcagaagcttcacgaggagaattccgtattttccggtgtcaatttatccaggaaccgcggacatcagaatgcgcttctggcagggattgcggtggcggcggaacatgcggatatgatcgtctccatggatgcggatctgcaggacgatgtggatgcgatggaccgcatgatcgatgcctatgaagcgggaaatgatattgtctatggcgtgcggtcttccagacagaaggacacgttttttaagcgcaacacggcacagcttttttaccggatgcttcatttcctgggggcggagatcgtgtacaatcacgcggattaccggctgttaagcagacgtgccgcaaaaggactcctgtcttttgaagaggtgaatctgtttctgcgtggaattgttccaatggtgggctatcagagtacgaccgtaacctatgagcgcggggagcgtttcgcgggggagagcaaatatccgcttggaaaaatggtggcatttgcgctggagggagtgacatcgctctcggtcaagccgatccgcatgattacgatgggcggattgtttgtgtgcctcgtcagcctgggaatgctgattaaggcgtttgtggattacgcgaacggcaatgtggaaccggggtggacaagtgtgattatttccatctgggtgctcggcggtctgcagctgtttgcgattggaattatcggagagtatatcgggaagacgtatatggagacgaaacggcgtccgagatatctgattgaatcggtgcttttggatgcagtagagcaggaagacactcccggcagggaataacggttttgatttcggaataaccggttgtgatttcttttgggcatggaatctgtggaatagagggttttatgagtaaaaaatataaagtgtggattttttgggcattgatgctgatcggggcacttctggtggtaagtcagggcagctattcggatggcgacgatgcctttttttatcagtatacgaacagtatgggatttggagagtatctgtcctggcgctatcagacctgggtgggaagaatgtcgggagaggcgtttgtgtatcttgcgttccggctagggctcggcttctggcgtgtggtaaatgccgtgatgctggtgcttctgccggtgggggtgctgcgcttgtcagaaaaggcggcagggattggtgtacacagtgaggaagcgatcggaccctgcgcagcggcagtgggcggctattttctcatgaacattatgactgtcggctatgcggcggtctgggtgaatggttccatcttctatacctggtgttttacctgcggaatctgggcgctgatgccttttgcggacgcagtgttcgcaaagccgggggaagagcctgcgctgaataagaaatattttctgatcagcataccgtgcgcggtggcaggaacgatgtccatcgagcagatgagcgctgttttgctgacgtttgaggtgttggcggttgtcgcactgttccttcgccataaaaaagtgcatccgcttcttctggttcagacacttacgacagcggtagcgtttgtgattctgttctcggctcccggcaatgagatccgtgtggcaagtgagattgcaaactggatgccggaatacgagacgatgcctttcggacagcatgtgttcatcacgatacactggctgctgtcatcgtttgcaaatgagaacaaactgtttttatgcggcatctgggttgtgggaatccttcttctgctgcagcaggagcagaagaaaaagagagactggatcgctcttgggatcgcggcggtctttaccctggcagcactgcttccttatgcaggctttgatctgttatcggatatggggatgcagtatatcaatattgaagcgtgcgtgtaccaggtgccgtccatggcggtgatgacgcgggaagtgatccttgcgatgatctggtgggctgcggcgctgcttttcaccctgccgtttttatggcgcgtgtcaaaaaagcacatcacgctgatgctcgcctatcttgcgggaatcgcgagtgaggcgattatgtattgctctccgacgatgtatgcgtccggtgcgcgtgtttattatctgacggatcttttatatctgtttattattttgacacttgcattttccctgaaaaagaagcgctggagaaatggattctatgtgggactgctcgtggcgggcgtttggaatctggtgtggcaggtccttttttagacagaaaagaacagaaacatacttttttgatactttcgtcacaattacatcacattttccctgtaaactgcatcatagaaagtgagagagaaaaagaaatactcactggaacagaacaaagagttgtcagggaaaggagcaattattatggataacaatgaatgtaatcataaccagtcttccgattccttctattcatataataacggaacgaatcagaacggcacatcgcagaacaatggagcatacagcgcaaacggagcttaccagaatggcagcgcatacggtcagaacggaggaacctaccagaacggaggaacttaccagaacggaggaacctaccagagcggcacacagaataacagtgcatacggccagaacggaggaacctaccagaacggcggttatcagcaacagttctaccagagccagggagccgggaatgcggcgtacggtcagaatccttccggcaagaaggaaaagaagagaagagaaaagagagagagaaagccgggcggctttggtatgaagcttgcaaaatgtgcggcactggcacttgtcttcgggctggtatccggaacggtgttcgagggcgtacatctcgcatcgggtcagattttcggagactcggattccacggtggcagccacaggcagcgtgctgacacagtccgattccaacaccaagattgaggcgaccggcgcatcatccagctatgtggcatccgatgtctctgacatcgtggaagcggtaatgccttctatcgtatcgatcacgaatgtgagcgaatcccagtatcagagctttttcggcggaacacagacacagcagagcacaagctgcggttccggtattatcgtgagccaggatgcagacaatctttacattgcgaccaacaatcatgtggtggagggtgcagacagcctcacagtcgcattcagtgacaacacaaccgtcagcgcggagatcaagggtaccgatccttccacagatcttgcagttatccgcgttgcgttaagcagcatcgattctgacacattaaatacaatcaaagttgcaacacttggcaattcggatgatctgaaagccggacaggcagcgatcgccatcggtaatgcactcggctatggtcagtctgtgacaaccggtgtcatcagcgcattgaaccgtgaggtaaccgtatccgattccaacagcaacacaaattacaccgcagaactgatccagaccagtgcagcgatcaaccctggtaacagtggcggtgcactgctcaatgcagcaggcgaggtcatcggtatcaactctgtaaaatatgcagacacaagtgttgagggaatcggttatgcgatcccgatcagcacagcaatgccgatcattgaggacctgattacgaaggaaaaggtagatgaggcagacagtgcatatcttggtatcagcggcgtcgatgtcacaagcgatgtggcaaaaacctacaatatgccgaccggtgtctatgtagcacaggtaaaagagaactccgccgcagagcaggctggaattcagaagggcgatattattaccgcatttgacggcaaggatgtctcctcgatggaggatctgtcctctaaacttcagtattacaaagcaggaacgaccgtggatgtcaccatccagagatcttccaacggacagtatgaagagcagacgctctctgtcacactgggaaagaagaactgacagagaaagggctgacacagaggcagtaagtttatgataggagcacttgcagggataagttccaaatgcaacaggcggcggtaaatctgaccgcaaaatccggcatttctaaccacgccgcgcttcgcatctgcgatgatctgtgtctttccaagctttgaacactccgcaggatgtgtccgcaacctgcagacaattttaggattctcgtgtgtcccttgcgtcaccagggaatccgctcattgtctgcggtttgtcggacacatcctgcggagtgtcaaagcgtggcaagagacacagaatgtgatgcaaagtgcggcatggaagaaatactcgaattttgcttcaaagatttaccgccgcctgttgcattttggaaccagacacctgcaagcccgttatgataagccggctgcctctgtgtcagtccctttgatctgtcagtcttctgtctcagtgttccatcttccagaaggctgcagagtaaggcgggagcgtactgccacctccaaagtcgtgcgtctccccggtgagcaggtcaacagctgtgccgcagcttgcgtcgaaatgcgccgtgaagctttcggaatctgcgttgatggcgactagcacacgctcattggcgcttttccgctcaaagatggactgcttattcgtgagcaggacagagcggaaatcgccgtagtttaacgcctcggaagactttttcgcggcgacaaggcggctgatgaaatccgtgagcgtggtccattccggtgcgtcaaagcaggcgcgcaatgcgggatcgccgtcctcttttcgcgctttggcaccccattcacttccgtagtacacgcatggaatgcccggcatgccgaactgcatggcatagattaacggaaggtgcgcctcgtttgagaggatgcttgccacacgggtgacgtcatggttgtcgacgaaggagagcaggtgctttcccttgtacagagtccagttgtccgggccgaactggcgcagcagagagtgattgatctcgaacatgttcatggagttaaaactggaatacagtcctttgtagcactcatagtttgttacggagtgcagcatggtgtcgttcatgatctggttgtaatcgccgtgtacgacctcgccgaccaggaagaaatctggctttaaggtgtcacagtaggcgcgcagccttcggataaaatcatggtcgaggcagtaagccacatccagccgcagtccgtcgatgtcaaactcatctatccagcccttgatgcaggaaaagaggtgtgcgatgacatcctcgttgtgcagattcagctttacgagatcataattcccttcccagccctcataccacagcccgtcgttataattggaattcccgtcaaaactgatatgaaaccagtccttgtagggagagtcccatctcttctctaaaacgtcctggaatgcccagaaaccgcggccgacgtgattgaagacgccgtctaagacgactttgatgccggcggcgtggaggttgtcacacacttccttaaaatccgcgttggtgccaagtcttgtgtcgatctttgtgtaatctctggtattgtagccgtgggtgtccgattcaaagagcggtgaaaaatatacggcgtttgcgccaagcttttgaatatgaggaatccagtcgtttaccttttggatgcggtgggtgagaaccccgtcattttcaaaaggtgcgccgcagaacccaagcggatagatctgataaaatacactttcatatgcccacataatgcgttgcctcctgtgattgcttttttatttcgctgtgctcatgtcgtgtgattttttagagcaggcgcgctgtgcagtgattacggtgtcacgcagaccgccccgttccaatgcggcgacagcctcgatcgtcgttccgcccggagagcacacggcgtctttgagttcgccggggtgcctgccggtctccaataccattttggctgcgccgtagacggactgggcggcaaatttgtaagcctgtgcccgcggcatgccgtcagcaacggcagcgtctgccattgcctcgataaacagatagacataggcaggggaggaaccggacacgcccacaacggcgtcgatgaggctctccggtacgacttctgcttttccaaaggagttgaagatcgcctgcacttcggaaagctcggcttcggtgacatgtgcattgacacacagggcactcatcgcttcgccgacgagggcaggtgtgtttggcatggcgcgaacgagcttgatctctttgccaaacgcctcttcgatggcagcaatggtcttgccagcagcgatggagacgatgatgcagctgctcttcacatgcggggcaatctgcggaatcacctcatcaaatttgttcggcttgacggcgagaaacagaatatcgctgcgctcggcgaccgtctcattggagagtgtcgtctcgatggaaaaccggctgtgaatggcgtcgagtgtctccttggagtgtgcactggcgattacctgccccgtggttaccagggaggcgtttaagatgccgccgatcatggcgctgcccatgttgccggcaccgatgaaaccaatgattttgtcaaacatatcaaaaaccacctttctatgtattgtatgctgataccagaacagccggctaaagatagccggctgtctttctataaaatatggtagcgtttttagaaccaaacgtcaagtcctggtgtacgatgtttagaaatctgtcagattggcagctctcttctcaaggaatgcgcccattccctctttcttgtcatgtgtgtcgttgacaacaccaaagaggtttgcttccatctcaacggcattcttgatgtccatgtcgtagccgttgttgattgctgccttggcaacggagactgcgtagcttcccttggagatgatctttgcagccatagcctttgcggtagccatcagttcttcttttgcgacaaccttatttacaaggccgatgcggtatgcttcgttggcatcgatattgtcacaggtaaagatcatttctttggcacgtcccataccaacaagacgggcaagtctctgggtaccgccgaatccagggataataccaagaccgcactccggctgtccgaaaacagcattgtcggatgcgatacggatatcacacgccatagcaatctcacatccgccgccgagagcaaaaccgttgacagcagcgatggtaacctgacgcatattcattaacttgaaaaatggaacagaagccttgatgccgaatgctcttgcttccggagcggtgaagttcaccatctcggagatatcagcgcctgcaacgaaagacttgaactcgttgcccttcttgtccggaccgccggttaagatgacaaccttgacatcgtccatagcttcgatctcagtcagagccgtgtttaactcgtcaagagtctcactgtttaatgcgttaagagctgccggtctggaaatggaaagaacagcagtctggtcagcgatttccaatttcaaattgttaaattcactcattctaaaaccctcctgaatagtttgataaaaaattaacaaattactaatattagagtacagcgttttctaaaatttgtcaatagaaaacagtattttcatttggaaagaaagggggtataataaatcctaaaatgagtacgttactaaggagtcatacatatgagcacaaagagatcttatctgtcaaaagttgttgtggagatgccggattccggtattaaggattttttcgatattgcaaataccatggacggggctctgtctcttggcgtcggggagccggacttccagacgccggagcatgtcagggaggcggcggtcgcctccatccggcgcgccgagacgaagtacaccgacaaccgcggtaccgtggagctgcgtgcggcggcagcggagtatctggaaaagttcgatctgcactatgaccgggcggatgagatccttattacaatgggtgcaagcgaggggattgatctggcgctgcgtacgctggtggatccgggagacgaagtgctggtggttgaacccgcctatgtgtcctacgttccctgcgtggagctgtgcgggggaattccggtatcgattccgctgcaggcgaagaacggattccgtctgacggcggaggaactggaggaaaagatcacagggcggacaaaagtgcttctcatctcttttccgaataacccgacgggcgccatcatggaaaaggcggatctggaggcgatccgcgaggtggtgctcgcccatgacctctttgtgattacggacgagatctatgcagagctcacctacggcagaaagcatgtgtcgatcgcggcgctgccggatatgtatgagcgctgcgtggttctaaacggtttttcaaaggcgtttgcaatgaccggatggcgtatgggtatcgcggcggggccggcggaggtcattttccatatgaacaagatccatcagttcacgacgatgtcggcggggacgacttcacagtatgcggcattggaagcgttcacgagtccggtgcgggacgaggagatcgatgtgatgcgccaggagtatgacgagagacgtcacctgatggtggacggattccgggcgatgggacttaaggtggttgagccggagggagcgttctatgtgttcccgtcgatcaaagagatcgggctcacctcgatggaattctgcagccggcttttgcaggagcagaaggtggcggtgataccgggagatgcctttggaagctgcggcgagggatacatccggtgttcctatgcgtattccaaggatgtgataaagaaatgtctggaaaaaattgcggcgtttgtggcgcagtttgacctggatttaaacgcttgacagtagagacggagaagagaatgctggataattatcatctgaaccagttggcagagcctctgcttgcgtggtttgtagatcacgcgcgggtgctcccgtggcgtgagagaccggagccttaccgcgtgtgggtctcggaaatcatgctgcagcagaccagagtggaggcagtaaagccgtattatgagcgctttttaaaagcattgccggatgtggcggcgcttgcagcctgtccggaggatcaattgatgaagctctgggaggggcttggttattacaaccgcgtgagaaatatgcagaaagccgcagtcaccgtgacggaggagtatgatggagtgcttccggcggattatgggaagcttctggaattgaaagggatcggttcctacacagcgggtgccatcgcatcgatcgcctatgggataccggtgcctgcggtagacggaaatgtgctgcggatcttgacgcgtgtggcggcggacgataccgacatcatgaaacagtcgttccgcagtgcggtggaagcgcagctgggagagatgatgcgggaacttacggttcctgaggagcttcggcgtgtccttcgcgatgaaaatgttcccggcgcgctcaaccaggcgatgatggagcttggggcgacagtctgtgtgccgaacggcgcacctctctgtgaggaatgtccgtggagtaagatgtgtcttgcgagagcacaggggcgcatgatggattttccggtaaaaagcaaggcgaaggcacggcggattgaggagcgcacggtgcttgtcattcgggatggagaaaaggtggcaatccgcaagcgcccgaagaaggggctgctcgccgggctgtatgaactgccgaatctgtccggcgcattgagcgccaaggaagttctttcctatgtaaaagaacagcagtttgctccgctgcgaatcgagaagcttgcggatgcaaagcacatattttcccatatcgagtggaggatgagtggatatgccattctggtggaggaagccggctttgccgcagaaaaggaaccagagtcaggaaatgggcgcaccccggaagagaaagcggacggggaaggcggactgatttttgtggatgcatgggatgcgagagagcgttatgccattccgtcggcattttcagcatatgcgggttatttaaaaaaggaatttgattaagatcaagaaagataaaaaagtttgtaaaaaagagggagccggtgcattgcaccggcttttcatatgaaaaagattgtgtgtatggaaagtgaaataaattcactatctgctgggaggaaccttgcctatttctaagcaaggtgacctgacaagcacttgtcaggaatgaaaaagttctatgaaaaatttaacttgctgtcttaactttatctatactataaaatggaaatatgaccagcgtatgccaagtttattagtattttgtaaataaaatatgaacaaatgaaggaagtggacatttttcagtggatattttgaaaaccttaaggaaaaaataaattggcgtactgtggaaaatcctgtataatgaaacaggtcaatgttaagacaatgcgggcagtaccgcagaacggaggagacatgtacgattgtattgtcattggagccggaattgccggagcggtggcagcgcgaaagctggcagaggaaaaaggaaagcgtgtccttgtcatggaacgccgaccgcatatcgggggaaactgttacgatgagaaagatgcccacggcattttaattcataattacggaccgcatatttttcacacaggtctggaggaagtgtttgcatatttatcgcgttttacggactggtacctgttcgggcacgaggtggtcgcaaaggtcggggatcagctgattccggtgccgtttaacttaaatacgttacatatggtatacgggaaggagaaagccgaccggctggagcaaaagctgatcgaaacctacggcgagggttcgcgtgtgccgatcatgaagctgcgcgagaacgaggatgcggatatccgcgagattgcacagtatgtgtatgagaatgtatttttatattacacgatgaagcagtggggtcagaagccggaggagatcagcccggaggtcacagggcgcgtcccggtgttaatctcctatgataaccgctattttcaggataagtaccagggagtgccggcgaacggatttacagaaatgtttgagaagatgctttcccatccggggatcacggtggagtgcggcacggactgcttaagccgcatgcgctttgcggacaatgagatttattttgacggcgaaaaattcgacggcgacgtgatctacaccggcgcgctggatgaattgtttgcatgcaggtatggaagactgccgtaccgctcgctggatttccggtttgagcattacgacggggcgtcttaccagggacacagtgtggtcaactacacggtgagcgaggattttacccgtatcacggaattcaagtttttgaccgggcagagggatacggacggcaccacgatcgtgaaggagtatccgtttgcgtatacgggagcagagggagagattccgtactatgcgattttgaatgaggaaaatcaggcgctgtacgaaaaataccgggcactcacggctggcatggagcattttcatctgctcggacggctggcggagtaccgctattacaacatcgacgcgatggtgaagcgcgccatggaactggcagacagattgtaagagtgtgacggaaaatctgccttttgggaagaaagccgggttttcttttacggaaataaaggagagattagaaaatgaaattgttgacatttgcgattccgtgctacaattcggaagcatatatggaaaagtgtatcgagtcgctgcttccgggcggggatgatgtggagattttgatcgtggatgacggatcgcatgaccgcacggcagagattgcggatgcgtatgagaaaaagtatccggggattatccgggcgattcatcaggagaacggcggccacggcgaggcggtcaatgcgggtatccgcaatgccaccgggctttattttaaggtagtggacagtgatgactgggtggatctggatgcttaccgcaagattctggataagttacgggagatttccggcggtgacagagtgctggatatgtttattgctaattatgtatatgagaaagagggagtgaagcataagaaggtcatgcgctgctccaatcttccgaaagaccggatatttacctggaaggaagccggacattttcacaagggacagtatattctcatgcattccgtgatctaccgcacgaagcttctggtggagtgtggactggaactgccgaagcacaccttctatgtggataacatctatgtatacaagccgcttccgagtgtgcggacgctctattatatggatgtggatttttaccggtattttatcggaagagacgatcagtccgtcaatgagagagtgatgatttcccgcattgatcagcagatccgtgtgaataagattatggtcgatgcgtttgacctgtggaaaattccgaaccggaagctcagacattatatgttcaactacctggagatcatcacagtcatctcgacgatcatgctgatccgctccggcacggaggagaatctggagaagaagagagaactctggaaatatattagagaaaaagatatccgcctgttccatcatctgcgggctggaatcctcggcaatacgatgaatctgccgggaaaaggcggaagaaagatctccgttgcggcatataagctttcacagaaggtggtcggcttcaactagcgggaatccctgctctgtgtccgggagagatttttgaggaaatacatgatcttaaagttccagatgtaaccggcagcaacattctaagcgcaaaatccggtatttctaaccacaccgcgtccggcatctttgatgatccgtgtctttccaagctttgagcactccgcaggatgtgtccgcaagccggcagacaattttaggacttttgtgtggcgcttattcgccccagacaacagctggcataaatgccacctttatgtcgaacaaaacataaccgcgcgaagccgatgtttgaattggcatctgcattattttcaatagcagatgccaacgagtttcggttcgcgcggttttatattgtctgtgaagaagtggcattagcgccactaaaaagtccgctcattgtctgcgggttgtcggacacgccctgtggattgtcaaagcgtggcaaagacacagaattggataccggacgcggcatggaagaaacactcgaattttgcttcaaagaatgttgctgccggttacattctggaactttatgcacacgcattgaatgaaatatactcttccagatacagagcagggattccctgcgattaagaatccatactcatctcgtttaagagggctgttttcatatcgtagagcttctgggacagatcgacatagatctcctgcgggttgacgaaacgcttggtctcatcccagatggtgtctttttcatggttacagatttcacggatctccatgacgctcggggaagtgtagacagtttttccgttctttattactggaatcagcatctcgcgcagagtgtagcttccgcccggaagtctcgtctttttccagggagcgttcggatcaaacagctttaagtcttcgctctcgtcgaatgtctcatcgtacaggcagatgagatcggccttgatcttgccggtctttttgtcatagacgcggtaaaatgtcttgttgccgggatttgtgactttttctacattctcagataacttgatcttcggctggaaacttccgtctgcagtgcggatggcggcaagcttgtaaacaccgccgaaggcagggttgtctttcgaggtaatcagatttgtgccgacaccccaggagctgatggttgcgccctgcaattttaagctttcgatcaggtattcgtcaaggtcgttggaagcggagatcacggcgtccggaaaaccggcttcatctaacattttgcgcacctgcttggagaggtaggcaaggtcgccgctgtccatgcggattccgtaataagtcagcggaataccggcatcgcgcatctcggtgaagacacggatggcattcggaataccggattttaacgtgtcgtaggtatccacgagcagaatacatgcggacgggtagagctcagcatatttgcggaaagccgtgtactcatccggaaaactcatgatccagctgtgggcatgtgtgccgagtaccggcacatggaacatctgaccggcgagaacattggaagtgccgttgcagccgccgattacggcagctctggcaccgtaggtaccggaatccggaccttgtgcgcgccgtaaaccaaactccatgacattatcgcccttggccgcgtaacagacgcgggcggccttggtcgcgatcagacactggtggttgacgatatttaagatggcagtctcgattaactgtgcctccatgatgggagcgacaacttttaccagaggttctctcgggaagatcaggctgccttccgggacggcgtagatgtcgccggaaaatttgaaattgctcaggtattccagaaaatcttcgtcaaatattttcagactgcgcagatagttgatgtcgtccgcgtcaaaatgcagattctcgatgtagtcgatgacctgcgctaaacctgcgcagacggaataaccgccgtcgcagggattgttgcggtagaaggcgtcaaagacgacaacatcctgattatgatttttaaaatatccctgcatcatggtcagctcatagagatctgtgagcagggtaaggttcaatgtactcatgtgtgtctggaaccaaagttccgctcctttcctgttttgagattggaactattataacataatcgttgagaaaatgtaggaaaagttatatagttaaggtattctgaaagaaatgtgaggcagggaatgggatgagaagagagcgtgcgatggcactgtttgaagaaggatataattgtgcgcagtcggtatttctggcgttttcggatttacatggaatggatacgcacacggcggcggcactcagctcgtctttcggcggcggaatgggaagactgcgcgaggtgtgcggagcggtcagcgggatgtttcttacggtgggcatattatacggctatgacgacccgggcgcccgggaggaaaaagcggcacactatgcgagaatccaggaactggcgaaggcgtttgaggaaaaaaacggttcgattgtctgtcgggaactgcttggtttatcggtaaagcgggaagaaccgacaccgaaggaacggactgccgagtattataaaaagcgcccctgcaaggaacttgtcggggatgccgctgagatattggaaaagtatattgcagaacatccggtggatgagaggttagaaaagagaggaacagtcagatgatgattcgcagagcagccatacaggatctggaacagatcatgcagatatatgcgagggcggtgcagtatatgcacgcgtccggcaaccccaaccagtgggtggaggggtatccgtccagagcgttgattgaggaggacatcgcacgcggagtcagttatgtagttgacagggatggcgtgattgaggctgtgttttcctatatagaaggggaggatccgacctaccggcagattgggcaggggatgtggcgcacgaatggaagttatggaaccgtgcaccggctggcatccgccggacggctccgcggcgtggcgggaatctgcttttcctggtgtgccgagcaggcaaaaatgcatggctgcagcagtcttagggctgacacgcatcaggacaaccgcattatgcagcatcttctgcaaaaaaacggatttgtgtactgcggggtgattcatctggcaaacggcgcgccgcgtctggcgtttgagcgggctgccgtggcgccggaaggagtaaatccgggaatgccgcagcagaaacagaaaggggacggcagaggatatggcattgcatcgctcatacttggaatcgtgtctgtgctgctgttttgtacctgcatcaactgggtgacgggaattctggcgattattttcggaatcattcagatcacgaaaaataaggagcatggtcttgcaatcggtggaatcatcacagcggcgatctcaatggtgctttctgtcgttttatatcttgccatgtggttcggaatgacaaatgcggggattacatacgaagatctcctatacgatcagtatgatgacagctatgacagcgatggaagtgatgcatggtacgacggcgatggaaatggcagttatgatggcggcggaaacgacggatggtatgacgacggcggaaacgacggatggtatgacggtggcggaaacgacggatggtatgacggtgatggcagtggcggctacgattactataatgatccctacgattatttcagagattactatgacgttcaggagccgggcggcaatcagtttatgtgagtgttttcggcaatgaagtgatagcatcgcgcttttcggaatatactctaagtgacagagcataaaggtcagagtagaagtgcggatagcaggaagctggttttataataaaaagaaaagaggcagactgatctgggtgacagcaggaatggcatgtatggcggcggggtgttgtgtagctttttgcatgcaggtatccctgcgtgcgccaacagaggtcagggagacgatggcgatgaatgaatcggtaaaaaaagtggcaattacattcgacgacggacctaatccggactatacggagatgcttctttcggggctgaaggaacgtggtgtgaacgccacgttttttctgttgggaaaagaagtggagcagtatccggagatcgtgaagaaaatccatgagggcggacatctgatcgggacacactcctatgaacatgtcaatctgagcaatctgaccgatgcagcggcgatcgagcaggtggataagacgaacgcggcgattcatgcaattatcggtgagttcccggagtatatccggccgccgttcgggtgctggaaaccgaatctggattatgagacgacaatgattgaggtactctgggatgtcgatccgaaagactgggcgacgagcaactcatcggtcattgcgcagcgcgtgctgggggatgtcgaggagaatgatattattctgcttcatgatgcgtcggagtcgtccgtgctggccgcgtttaagatcatcgatgaattgaagacgcaggggtatacatttgtgacggtggaggagattctgctggagtgagacgcgaaagtgcagcgcgggcaaagtttgtccgcgctgtttatctaaatggaaaatattattttatatgatactaaaattgcgagaaaaaatcacctgatgcgcattgaaaatagggggaaatggtgataatataatatattatatgaaattgaagagaaaaaatcgaaggagagatattttatgatatgtcaatttacatttgaaaattataaagcattttcaaaagaagcaatgcttgattttactgcggagagaataaatgagcatgaaagcagtttgctgattgatgaaagtgccggggagcgacttgtgcctgttatagctatttacggacctaatggaggtggtaaatcgacagtattggaggctttaaattttttgagagacactatattgcgggttatagtgctgacaaaactgcacgatgaggaggaaaagtatgaaaatgttatacgaaggttatcttcgacagggtcgaaagaaatatactataagctttctccggagtacaaggatttacctacaaaatttgacattatgtttttggcaaaaggcagtaaatggcactatcagctcgcgataataaagaatagaattatatctgaaaatttatatgcacaaaaagcgggaacaaatgacgtgcggcttatatttgaacgatcggatgaggaatgcattctgggtgaggaaatagaagatattgcggttgaaaaagtaaatgatactatgcccttactttcacatattgctattaattatgatatagaaagtattgatacggttgtaaattggttctttgatattaaagtgcttaattatgataaccctcgtaatgagaagaaaatattattaccaaaaacaaaagagaaaagaaaatggttatttaagatgttggaagaaatggatatagcaattaaggatatccgcattgtaaaagatatagatggtaacatagaagatgtatatacgaaacatgtaatggaaaatggtaaaatgtgtgagatcagtctggatgaagagtctagcggtacgagaaagctgcttagctgtcttggaaccataaacaggtgtctggaagagggaaatttgatgattgctgatgaacttgatgctaaactacatccgaaattgctgcggtatataatagaattatttacaaatccggaaagcaataaaaatggggcacagctcttattaacttcacatgatattacgacgatgaatcatgatgtatttcgtagagatgaaatatggttttgtgcaaagaatccgtatggggcatcaaaattatattcacttgtagcatttcgaaaaacagatggaagcatgataagaaatgatgaagcatatggcaaacgataccttgagggacgttatggtgccgacccatatatacgaaaaattataaattgggaggattgcgaatgagtcttaaacctaagaaatttagtgaacttaagatacaacaagatgaactccagaaaaaaatgcaaaagaagaaaaagaaaacgaacatagtattgccgccgtatacttatattgtaagtgaagggacaaaaacggaaccatattatattgaagcgatggcacaggtaataaatgaaaaatatagagagttttcaacgggcaagtttgtggtagtagagggaacgggcagaaacacaaaaggattattagagtatgcaagagcaaatgttgccagaaattttcctcaagcggaggttgtatggctcatgtatgataaagatgatttcccgttggataattttgacaatacacaatacagtgcagaaggcaagaaagatgtgcgcgaataccgggtagcgtggtcaaatgagtgtattgagttatggttccttcttcattttcaggaactgtctgttaatgtgggaagagaaaaatacagagaattgctaaagggttattgtcaatatgagaaaaatatgaagtcaatttatgatgtacttcgagataaaacacccattgctatagcacgggctaagcgtcaatatgaagcatatggagatactgcaccatctcaaagatgcccggcgacaagagtttatcagctggttgaagaattgcagaactacatttagcctgtaagagattctgactataataagattattttaggatagatattaagaggatctatgaagaaaaaatggattgccgttataacggctgtatgcatgataagtttgtttggctgcctgcattatctacatgaaatgcaggaagaaaagtatacagtcataacttctgtaaatggtgtggaatttgatgtgccgaaaaattatttgacgcaggctacagctattacaggtatttcagacgatgaggattacggtacatatacgtatgtatatagtgacgggaaaagtacctatttattatttgatatggatcagattataatgattgttgacaatcagacggattacggattacagaattctacaaacataggggaaacaattactgaaaagccaatagatggtgtctggtttaatttggaagataaagcagaccaatatgacatgaaaatcaaaaatgatgcgtatcggttaattcataccgtacgaagtgacgtatcagtaacagaaaatcagggtggtacgtttgtgggaaaatttgcaaatgtatctgttagtggggtggaatgctccatgtttgtaggcgcaagaggagaatgttattctgagttggattttgacacgaaaagaatgcttgaacatatcgcaaagtctttgaacattacagatcacacagcattgtctaatgttgatataaatacagatttgcctgtgtcaggcaggaagggaaaacttgatatagcggataatcagggagagatcggaaataaatattctgatatctatcatttgttagctgttggtatgacaggaacttatttggcgtatgataaaaattcagaattctctttatcaagtggggaaatcacagttgagcagttatacacaggagaggatgccatagatatcataaaagcgtattgcaattcgggaaaatctatgcggaaatatatggaagcaccagaaggattctcttggcatgttataaaatacagtctatcgcagtctcagaaagacttatatacaaatattaaaattgagggtctggatggaaacagactggtttatcatggtgtttcatgtacgagtaggacatatgatattatatacgattggaataagaaaaatgacctgtattgctattacgcagtaccaaatggatgcaaagaatacatgctggagtgtggaaacaggtataagtctacatcagagaccgcctgttatcgtataaacatagtgaattcagagtaataggaaaaatacaaatgcaggttgactttttgctatattacatatattatacaaatgtaactgtgatatgtgttaataatactctaggttgtacatctctcagtatctgagaatgatcgaaccctagagtttttcatttaaaacaagtaaatattttgagtaactttttattatagattatagaatgtagtttgcgtattagagacataacctgtataactctacaatcaaataactggaaacgtatgcatggcgtaccattaaaggcaaaacctcgcagtttgaatggcaacttgcttgcacttattaagttaaatgatcgttatgtgtcaagtcgaagcccgaaaaaaaggaaaaaagctcgtttcagagggacttttaatgtttttgcaatccagcagaaccccgaataccggctttatcacagatatgggtaccagaaagagaaatacaggcgcaaggtaaaacgcgcatacaataagtaagaggaggattgttttatgaaatatttttcaagaaaaagaaaaccaaaacgcttttatgtacttgtcggcttatttacagcaatgacattgactgcgtgggctaacttcacctacatcgaccacaaggctgaattgactctggaggcgggaagtaaagacgatcaggtagattccttcattagttggggagaatacggcgtagtgaatgaaatggtgctggcaggcggtgtaacatctggaaaagcacaggagattttaaattctggctactgtcttcagtatatggattcatggaaagctgccggaaaaattccgtcggacttcacacctgcatcccagaagagcagctcatcaagcagcacttccagcaatgatacacaggcaacagcaaccgacaacagcggatctgattccaagaaaagtgacaccaattccaccaagacttatacagacgcggagatcgacgcggcatggaaagcagtcacaacagtagatccgacgtgcgcaacggacggttacacagaatataagaacagtcttacaggaaaaaccaagcaggaagcaatcccggcgaccggtaagcatacctacgaggtaacggacagcacggatgccacctgtatcgaagctggcagtgtaacatacacctgctctgtctgcggggacacttacaccgaagagacagatctggcggaacatacctacgaggtaacggaaacaacggatgccacctgcaccgaggacggaagcacgacatacacctgttctgtctgtggggacacgtacgaagagacgattccggcgaccggacacgatgacggcgaatggacagtaaccaagagtgccggagcattttcaaccggaaccaaggagttgcgctgcaccgtctgcggggaagtgcttgacacagaaaccattccgcagacctgcccgatcccgttatttggcgttgtagccattgttgtgatcgcgggcggcgtgattggtagaacgattagcgtagtaagaaaagcaaagaaaaacaaggcagattaactgccttgtttttctataaagcattccggaagattgcgctaagattgaacagttctttggagataacatcatttacagaaatatatggggtatcccaaaaacgtgaatcaaaagacagctcccgattatctcccatgacaaagagacattgagaaggaacaacaaatgtatcggtacagttcgtctcaacatcttccggcagataggcactctcatcgagctgtttgtcgttgatgtatacataaccatcataaaaagtaattttatctccggccactcctataacgcgtttacaataggtggttccattaagatgaaaaaataaaatatctccggcttgtggttcactggcaatataggcaagacggttaccgatgacgatatcgcctgtccttaatgtggcttccatagatccgcttttgattgaaccgatagagagtatgctgtttaacagaaaaattataatgctaatgcatataaggtatggaagaaactcacgcaaatataagacgatggatgcgaaaggctggtgtagtttttttgaaaaattgttctcacaattcaagatagttcctccgatatggtatgaaataagtagccattagttcataatcatgaatgtctgttacttacgttgcaggtgttgtggcttgaccagagttatttactgatgcatcagtgtttatggggtatcactatctgttgttggtgcggattgctttatggagttcgcgagagcagcagtagttttttcatcatatgaagtttccaccgagccatcccaataacatatggtggttgctttaataccatttttgtaagttataatttcgatttcgctccaatcggttgtcccttgtacgccgtctattacggtccagtctgctatttcggattcatctgcagaatctgtctctatttgtaagtgtgttgcaatatcattactctcaaaagcttttttataattttcgatgagagataaatcttttaccggcgtttctactggatcagttgtttcgatttcaaaattcatgagggctttatattcttcgtctgtaaaaatatttttcgcactttcttcaaatgtcacttcatctaccggattattttcaacgtaataattttctgtataagaatcctgaaatcccatttcatataatggataatcactcttgtaagacaacaataatttacgttctccattctcaatggtacatacatcaatctcatttccataggaagactcctgtaatcccagataatatggagttccctccaggttatagaggaaaaggctggttgccgatgcactacagtccaccaattttacagttccattataataagtatataaatcatatctccagtcggcgcatccgggaaataaaaataactctggaattccatccaaatttacatcgactattccatacgtggcagcatcagcatcttgaatttgcagcccctgattacttgcatccggtaatattgcacccgactgaagaaaatctatgtaagcctgcttccaatcctctgcattattaggtgtttcacttgattcttcctgcgtaacgattgtttctgttgcgctttcttcttgtacggttgattcagtagatgacgttacctgatctgtctcagttacttcgttttcctttacaggttcatttttctgagaatcacacgctgaaagtgatagacctattgtcattaccaatactgatattaacactttttgtttgttcatattctttttcatatgtaattcaaaacctccattatgatttactatattgtatcatacttaagatgtaaaggataaaaaacattttatgacagcgttagaattagatttacagattcacttgcaaccctccgatcaatttgttacagtatagaaaatgatttccggggaaaatcgtgcacaacagagaaaatgcatatttttacttgtaaaaagggcatatatcgtgtattgtaatagaagtgatgcaattttgatgttgcaatctgtcatattttttggaaaaatcatgattaaaaccacgaatcattaaaaaaatgcaagttttacataaagaaaattcaaaacggtcaagtgtacgctgcgcacggacatacgccggaaggcagtgaccgggaatttttatacatcagaaagcaggttttgacatggacttatttgaatatatgagagaacaacaaaaggaaacggaggcgccgcttgcatccagacttcgccccacgacgttggatgagatggtggggcagcagcatattataggaaaagataagctgctgtaccgtgcaatcaaagcggataagctaagttccatcatactgtacggtccgccgggaaccggtaagacgacgcttgcaaaagtcatcgcgcatacgacgagcgcagagtttttacagatcaatgcgacttctgccggcaagaaggacatggaggaagtgatcgcgcaggcgaagaacaaccagggaatgtacggcaggaagacgatcctctttatcgatgagattcatcgcttcaataaggggcagcaggattatctgcttccgttcgtggaggacggcacgatcattctgatcggtgcaacgacagagaatccgtattttgaggtcaacggagctttgttgtccagatctatcatttttgaactgaagagtctgtcgaaggaggatatccggacattgattctccgcgcggtaaccgaccgggaaaagggactgggcgcttataatgctgtgattgatgacgatgcgctggaatttctggcggatgttgcgaacggggatgcccgcgcggcactcacggcgatcgaactcggcgtgctgacgacggagcggagtgcagacgggaagattcacatcacgcttgcggttgccagtgaatgtatccagaagcgcgtggtcaaatacgacaagtccggggataaccattacgacacgatctccgcttttatcaaaagtatgcggggttccgatccggatgcggcagtctactatcttgcgcggatgctgtatgcgggagaggacatcaagtttatagcaaggcgcatcatgatctgtgcggcggaggacgtcagcaatgcagatccgatggcgcttgtggtcgccacatcggcggcacaggcggtggagcgcatcggtatgccggaggcgcagatcattttagcgcaggcggtgacctatgtggcgagcgcaccaaagagcaattctgcggtctgtgccatcagcgatgccatggcggcggtgcgggataccatgacggcaccgataccggtgcacctgcaggatgcacattataagtcatcacagaagctgggacacggcgtcggttacaaatacgcgcatgattatccgaatcattatgtgaagcagcagtatctgccggacggtctgacagaccgcatgttttatcatccgtcggagaacggctatgagaaaacaatccgggaatattttgaaaaaataaaagggatgcagccttagaaataaggttcatataaaatgtatatacagatagcaggaggaaggaacaatgcagtcatatcaggagatgagcaaagaggaactgttaaaagagaaggaacatctggaagcagaatacaagaagttccagcagcggggattgaagcttgacatgtccagaggaaagccatcccaggaacagctggatctgtctatgggcatgatggatgttctctcgtcctattccgatctcgcatgcgaggatggaacggactgccgcaactacggtgtactggacggaatccaggaggcgaaagtgctgattggcgatatgatcgagtgcaatccggaaaatatcattatctacggcaattccagcttaaatatcatgtacgatacgatttcacgctccatgacacacggtgtgatgggaaatacgccgtggtgcaagcttgacaaggtgaagttcttatgtccggttccgggctatgacagacattttgccatcacggaatattttggcattgagatgatcaatgttccaatgcttccgacaggaccggatatggatatggtggaggagcttgtcagcaaggatgaggcgatcaaaggaatctggtgtgtgccgaaatactccaatccgcagggaattacctactcggatgagacggtacgccgttttgccagattaaaaccggcggcaaaagacttccgtatttactgggataacgcttactgtgtacatcatttatatgatatggatcaggatcatctgatcgagattctggcagagtgcaagcgcgcgggcaatccggatatggtatacaagttctgctcgaccagcaagatcagcttcccgggttccggtctggctgcgattgcaacttccgcgaacaatctggaggatattaagaaacagttgaagatccagacgatcggtcatgataaggtgaatcagcttcgccatgtgcgcttctttaaagatgtgcacggtatcacggagcacatgagaaagcatgcggcttccctcagaccgaagtttgagatgattctggacacattcgacaaggagttaaaggatctcggcgtcggaagctggtacagcccgaaggggggatattttatcacctatgagacgctggagggatgcgcgaagagcgtggtagataaggcgaaaaaggcaggcgttgtgatgacaccggcaggagcaccgttcccgtacggcaaggacccgaaagattccgtcatccgtatatctccgtcgtatccgtcgctggaggatcttacaacggcaacacagatttttgtagtctgcgtaaagctggcaagcattgagaagattctgggggaacagcaggcgtaagagcacagagcagggaatgatatgaaaaaaataattggaatagtgacaccgattcttctgctgattttaccgtatctgctttttgtggttctgtctgtgggcatgggaagaccggacagagattcgtctggagcctatatcatggcgggcgattccagattgcagatgacgcagacggcaatctgcattgtctacacggtggtcgtgctcttaaatgtcgtctgggtcatctatcagacggcggcaggaaccggcgcgcaggcgctgcttctgtgggatatgctgatgaagctgtgctatgtcccgtattatctgctggcggcgtttatggtgctggcgggatttgcgacgtttatgtttggcggagtcgcgattatcggcgtgatgtggattgcggatgtcctgtttttgataccgccgtccatctacggactgtgcggctgcatccgggcgtgcagtgaaaaaaagctgtccgtgggggtagcagttgccctgtcgatactgcactttatctttgtgctggacgttgtggcggcggtcgtcggattctgtaccgtacacggcagacacaaacgtcagaaacagatggaggctgccagacagccgcagatgacgtaccggaattgaacaagtgaatgcaaaacataaccgcgcgaaccgaactcgttatcatctgctattgaaaacagggcagatgataactcagacatcggcttcgcgcggttatgttttgtttgacataaagatggcatttcgccatctgttgtctgggtgccaacaaggggcacacacaaaagtcctaaaattgtctgcagcttgtggacacactacgtggaatgttccaaacttggaaaaacaaagatgttcaaggatgtttgacgcggcatggttagaaataccggactttgcgattagaattgccgccccggttgcatttggaacgtcatacatctctattacttataagaaaacgtatcccgttctaaatttggattatgcctgcgtctgggcagcctccgtctcctcggttccgttcttccacttgttgaacttctccacaacggcatcgtaggtgcgctgtgagatgtccggaagatcctgtccccaggacttggttgcttccttgaagcccttcttgaaagcgtcaagaagaagatcagctttttccggatcgttgccggagagtgcttttgcaaaatcaagaatacggtctgaagtctggtcgacgccccagtaaccgtcatcagcgatatctgcctgcgcctgtgccctggtggcttcatctacggtaaaatcaccttttgcaaggaagctccacatagaatctgcggtaccgatggcaacaccctgcttggtcatcatcttttctacaagactgcgaagctgggaggtacgctgctcggcatctgcctttaacttgttgacaagtgcgtaatcggttttctttgtaaccgtgccggatgtctgaccggaactcttctcatatacgacaccggtatcggtctttgtgctgctctcactctttttctctgtatggtccgtctttgctgcggtataagtagaagcccgctgtgctgccactgagtttgtaatactgttaattgccataattcattcctccattcccttggatcggtttaaaataattgacaggaggcatccatgcctgctctttgtctcatcttctatatcggcaggaaacattgcccggtttagatttttgagaaattttattgcgtaaaaagaaggagagataattgaccttttttacaagtcatggtaagattcagtctgtatacaaaatacattaaaaaaacatgggggcattatgaaagagatttcggtaaaagcactggcaaaagtaaatctcggacttgatgtggtacggaagagaccggacgggtaccatgaggtgcggatgatcatgcagacgattcatctgtttgaccggctggagattacccgcaatcagtcgggcaggattacgatgtcgaccaaccttgcgtttctgccgacaaatgagaacaatctggtatacaaggcggcagcacttctcaaagaggaatttgacattggggacggtattgatgtaaagctgcataagcacattccggtggcagccggcatggcaggcggaagcacggacgctgcggccgtattatatggaatgaaccgcatttttgatctggggctttctaaggaggatctgatgacgcgcggtgtgaagctcggcgcggatgttccctactgtattatgcgcggaacggcgctcgcggaggggatcggtgaaaaattatcggcgcttcctccgatggtcaaatgtccagtgctgattgctaagccgcagatcggggtttccacaaaatttgtctatgagaatctgaagctggatgcggataccgtgcatccggatattgatgggctgatcggtgcgatccgggcgaagaatttggagcagatcgcaggacacatgggaaatgtgctggagacagttacgattcccaattatccggtcattgcagagatcaaggatcatatgatggagcacggtgcagtccatgcaatgatgagcggaagcggtccaacggtctttggcctgtttgccaacggggatacagccgtggctgcatacgaggcaatgcgtgaatcaaatcttgcaaaacaggtttacctgacaagcatatacaacaatgcgcggtgaggagaagacgggcagaaacagataacaaagcagaaggaggtacttatgacagaggatctgacattgaacatgaatgcataccttccgcttcgggatgtggtgtttaacacactgcgggaagcgatcttaaaaggagagcttaagccgggggagcgtcttatggagctgcagctggcagcaaagcttggggtgagccgcacgccgatccgtgaggcgattcgtatgctcgagcaggagggactggcggtcacgattccaagaaaaggtgcggaagttgcgcggatgacggaaaaagacatggaggatgtcttgcagatccgggatgcgctcgacgaactggcggcatccatcgcctgcgagcagatttccgaggaggagcttgcggagctcagacataccatgcatgagttcgaggaatccacaaagacgggggacgtcaagcggattgcggaggcggatgtgcggtttcatgacatcatctatcatgcgacgcgcaacgtcaagctggagaacatgctcaacaatctgcgggagcagatgtaccgctaccgcgtggaatatttaaaggatgaaaagaatttcccgattctgatccgggagcacagccagatcgtggaggggcttaccgcaaaggataagaccatgctgacggcggcgatgcacaagcatgtgatgaaccaggcgacagcggtgaaggaaatgatccgggagcaggaaaagtgaataaatttcccgaaatggaacaaactaacagggacaggcggatgcctgccccgtttttgttttaggaaaggaagaaaatctgtggcggagaagacaaagatcagcgagagactcgacgagaacatcgcacatatggaggaactgtttcacacctgtgacgacatcaagaagaagcggatgaatcttggaaaaaaccgggacgtggcgtgctacctcacgttcattgaagtctcggtagatatgggaaattcggcgctgttagaagttttaaaatacttaaggggtctggagcgggaggagattctgcgggtgttggaacagaatgccctcggaacctccgatgcgacctattttacgacgatcgaggaggcgggggacggtcttttgaccggagaagccatctttttcgtcgacggttttgcgaaagcggtcaagattccggatgacggttatccgaatatggggatcaacgaggcggactcggaaaaagtggtgcgtggttctaacgagggattcggggattcggtaaaacagaatgcggcgttgatccgcaagagaatccggtcgccacaggtcaaggtaaaagagaaaaaaatgggcgtgcgctccaacaccaacgtctatctggtctatatggaaggaatcgtctatcccgagctggtggcaaagattgaggagcggctggagggatttgagattgacggggtactcgacagcggagtcattgaacagctgtcggaggaaaaatggtattccccgtttccacagtttcagacgacggaacggccggaccgggcggcaatgtccatccttgacggcagagtggttgtgctgtcggacaattcgccgatcgcgctcattctgccgaccgattacaattcctttatcaagacgagcgacgattactataaccgctgggagatcgcaagctttgagcgccttttgcgctattttgcatccttttttgccatgacattgccgggactctatctggcggtcaccaatttccacacacagattctgccgaccacgctcctgctgtcctttgcggacgccaggagcggcgtgccgtttccggcggtgattgaggtgattatcatggagctttcgtttgaactgctgcgggaggcgggagtgcggctgcccggagcgatggggaatacgattggaattgtggggggactgatcatcgggcaggcagccgtggaggcaaatctggtgagtccgattgtcgtgattgtgatctcgtttacggcgctgtgttcgtttgctgtaccgaatgaggagtttgcaacggcattccggctgctcaagttcttttttatcggaatctgcgcatggcttggttttttcgggtttctggcagggctgcttgccgtgctgatccatctgtcgcacttaaaaagctttggcgtgccgtacctgatgccgtatgtggcggcagatctgaacgattatgaagatgaacgcgatttcctttggcggcagccacttcggctgctctggaaacgcccgatctacgcgaagaaaaataaccgcagaaagctgcggatgaaacagtgacagagaggaaacggactatgttttcagaaaataacaggatatcgggacgccagatgtatcggctgatgacgtatgatctgcttggcatcggcacacttctcgtcccacagatgcttgcgaagacggcggggagagacggcattctgtcaatcggaatcgggatggcggcagcgctcgcgtatctatggatattgcgcaggcttgcgccgcccgcacaggaatcttatccggaatatatggagcggcagctgggaagaatcgggggaggaatcgtacaggcaggttatctgatctacctggtgctgtttgcagggtatgtggcgtatctatttgcagacattattctccgggatcttctgcgcggagaatcgttttatctggtcctttcggttatcatgctactggtgctgtatggacttgcggggggaatcgagggacgggcgagagtctatgagatgctgttctggtttcttttgatcccgctgtttctcatgctctttgctgcggcggatgaagtgtgcaccgattactgggcgccgcttggaatgagcagcttaaagggcgtggcaggcggagcttacggggtgtttttgaatctttcctttgcatttctgcttcttttttcgggaacgtatgttaagcggcaggaaacattgtttgcggcgggaaagagggcaatcctatttgtgggatgtctccatgcggtgctctatctggttctggagggaattttcggggtaccggcgcttgcggggatggattatccggcagtcacgctgatgagcacggtaaaaatatccggcggctttttaaaaagaacggatgcgtttatgttcggcgtgtggttttttacgctttatgctcttttaaacagctgcgttttttatggaagcagcatagcagaggaattatgtaaacctattctaaaaatgccaaaagggaaaaagtacatgtggattttctatggatctgtggcggtggcagcgtctgcggcagcaatctgtttttaccggagcagagcggtattcgactggtacgagcggttcctgtggtatgtcggaacgccgtttctggtgctggcccccgtctttgccgcacagaaaaaatggggaaggaggctgcttgcgcttgcggtgatctgtgcagttgtcctgcttgtgatgacaggctgtgcccccgcggagctggaggatcgtgattttccgattgagattgcggtgagggacacgaaggatgccgggctggcgtggtatgaagcggagcaggcgggaaaccggatggtggattacagtcatctgaaggttctgatcctggaacaggaatttgtggaggatgaggcagccgtgcaggagtggctcgcgtttttgaaggagaagagcgaggtgccgcgcaacgcctatgtggtggtcacggaggatgccgaagcactgctggcgcagagtgagacgctgggagaagcggtcggggattatctggaggaacagtttgagaatgtgtcccagatcaaaaagcaggcgtaccccacgatcggatcgctgtaccaggagatggacaaccggcaggagacactgtttttgccgtatgttaccgtgaaggacgaaaaaccggcggtggagcagtattatgtgtggaagcgtgggatgccggcaggcatggttgacgcggaggcggcgagactcgctttttttacacaaaaccgcatgagggagtacggtttaccgttggaggagggaatgttactgctgtcggatgccacaaatgagatcacgttctcggaaaaggatggcgtgcgggaagtcctggtgacgattcactgcagcggaagcgtgcagggaaccggcggaaaggagaacaaaaaggagcttgcacttttggcggaagactatatgaaccggatggcggcaaatgtgcagcggaagcggcaggtggatcttacagacagttaccgcaagctcggaggcgcggcgcggggctggtatgaggagtaccaggagtgcggggagaactacgaggaagaggttgcgattgtctatcaggtaaaaataaactggattcatttatcataaagtgaataaaacggtatcaaaacgggaatcgtcttttgcagcagaggaaaggaagaaaatgccgttatgcaaagacgtaaatggatctggtacttgttgttgggaatgaatgtgatgctgcttgccctcctggaaatgcagtatgtgaaaaatcagagaatacaggagcagattgctgggaaggtgctgcggttccatgtgcttgccaacagcgataccgcggaggatcagaatttaaagcttgcggtgcgtgatgccgtgggaagccggatggcagagctgctttcggatgtcccggacagagaggcgtgcgagcaggtggtggaggcgcacctgcccgagattgcggagacggcgcaggcggtggtgcgggaagccggatatgagtacgaggtgcatgccgcgatagaggagacggaatttccgtccaaaacatatggaaaattcaccttcccggcggggaaatatgaggcgctgcgggttgtgatcggagagggcgaaggtcataactggtggtgcgtcatgtacccgaatatgtgctttgagggaagtatgtatgaagtcgtggatgagagcgccggggaggaactgaaaaaagtgttgtccaaggaggaataccgggcggtgcttgaggagggaaattataaggtgcgctgccgctatctgacatttttggacgacctgaaagaataggcttgattattccgccaaaagccggtaatatgagttgagataaaagggagtgtaacgatgacaaaagatgtattgatctccatcagcggtcttcagtttgctgggggagaaaacagtgaaccggtagaggtgattacctccggttcttattataagaagaacggcaggcattatattctgtatgacgaggtggcggaggatacggcgggtaccaccaaaaatatcatcaagctcggggatgaggtacttgatatcacgaagcgtggtgagacgaatgtacatatgatgtttgaaaaggacaagaaaaatgtcacctattattatacgccgtacgggaatctgctgatcggaattgacgccacgaaagtgcaggtggaggagacggaacacaatctgtccgtaaaagtggattatgcgctggaagtgaattatgagcacatggcggactgcaagattaccatgaatattcaatcaaaaaatgcagggaatttcaaaatctgaaataccctgcattttaaatagctgcttattttttcttcttctttgctgccttctctttggcaagttctgccttttctttttccagctctgcattcgcctttttggctttttcctgcattctcgcacggaagctcttcttgccctgcggcttctcaagaggccctctgacgccggttaccttcgtgatatagatgccgctcacggtcgctttgacttccttcttcagcggaatcagatcatagacggcttcgtctgcgatcagtgacatcaccttcggaccaacctttgcctttacgattggaagcttggaatggcgcatcatcttcggtgtctggtcgatgacaacctgcggaagtcccgaatctttcaggcgcatccgctttttatcgatgatcagcatggagacggtctgggcgttggctgcaagctgtgcctcctgctcgtctctctttttctgcgcctttttgccgagaaaatataatacgatcaagccgacaatgaggacggcaagaataaccagcaatacaatgtttacggtactcatggtaaaatcctcctacaatcaaactgcatttaattgtagcattgattcggcaaaaaagcaatcttgtatttgaaacatttgtgaaagtttggcttgtctgcttccttttttgagggaaatgtggtacgatactaaggttagtgttggcgaaacagaattcgccaaaagagggaatagaaagggtatttgtatatgaagaagagaacagtagcactgatgctttgcgctatgatggcgtttggtgcagcaggatgcggagcaaaggacgccgatccggcagcgacagaggcgacagagagcgcaacgtcaaccgagggtcttgcagacagtgcggtttccggtacgatcacaagcactccgtgtgcgagcagcgcgtttgacctgaagggaagcgattatgtaacactctgtgattacagcgcgattccggttacgatcaccggggattatgacgtggatgaccagaaggtaaaggactatttcaagcagatgtttgacaactatggtccgttctatatggcagatccggacaagaccacggtcgaggagggagacattgtcaatgtggattacgttggcaagcttgacggaacagcgtttagcggaggtaccgccgagaatcagaacattgatgtgtaccagaacgcatctgccacaggaacaggctacatcgacggatttacggacggcttaaagggcgcttctgtcggagatgtgatcgactgtgacgtgacatttccggatgattatggcaacacggatctggcaggaaaagcagtagtctttacatttacggtcaactccattcagaaggaaatgacgatcgatgatgtggatgacgcatttgccaaggagcagttccaggtagataccgtggatgagatgtacgatcagatccgcagctacatggagagcagtgccgagtataataagcagaaagacactacgactgccgtgcagaattatcttatagataattgtgaggcggaagtgccggaggattatcttactgcgcgtgtggatgattacagaagacagtacattgagcagaactgcaacggagacgagagccagcttgccgattatgtgagcacctactacggaaagaccgtcgaggagatggaagcatactggaatgagggaatggaaaagagtatccgtctggaattcattatggatgcgatcgcagatgagctcggcgttgaagtgaaccaggacgatattgatacctatgcagagcagctggtaagccagaacggatacgagtctgtggaggcgatgtataatatctacggttttggagataccgactatggcaagcgctatttcgcagatctctaccgctacgaccaggcgctggatcagctgcttgagacggcggttgtgaccatcgatccgtctgcggacacagagagtgacgcggtgacagaggacgctgcggatgcaacagaggcgggcagtgcaacaaacgcatctacgacgtatgaggcagcagaaggcacggagaagaccggggcagccaattaggaataagcattgattttttgcggcaatgcagataagataatagaaaagagataatgagtggcagacgggatgcggcagagtggcgcacccgtctgttgcggatggaggaatgtatggatctggtaaatataagggatttatttcgcagcaaggatgagtatctggatacgacagtgaccatcggcggatgggtcagaagtcttcgtaattccaagaatttcggctttatcgttgtcaatgacggtacgttctttgagccggtgcaggtggtattttccaatgtgctggagaactttgaggaagtggagaagttaaacgtcggcgcggcaatcatcgtgacgggtaagcttgtcgcaaccccggagatgaagcagccgttcgagattcaggcggagaagattgaggtggagggagcttccacaccggattatccgctgcagaagaagaaacacagctttgagtatttgagaacgatctctcatttgagaccgcgcaccaacacctttgaggcggtgttccgcgtgcgttccctgattgcctatgcgatccataagttcttccaggagagagatttcgtctatgtgcacacaccgctcatcacaggaagtgactgcgagggtgcaggtgagatgttccaggtgacgacgatggatcttgccaatgtgccgaagaatccggacggaaccgtggactatacgaaggactttttcaataagccgacgaatctgaccgtcagcggacagttaaacggcgagacatatgcgatggcgtttaagaacatctatacgttcggaccgacattccgcgcggagaattccaacacgaccagacatgcggcggagttctggatgatcgagccggagatcgcatttgcagatcttgaggacgatatgatccttgcggagagcatgctcaaatatatcatccgctatgtgcttgagaatgcgccggaggagatggcattcttcaataactttatcgacaagggactccttgaccgactgaacaatgtggtgaattctgatttcgcacgtgtgacctacacggaggcaatcgagatcttagagaagcacaacgacaagtttgagtacaaggtatcctggggtgcggatcttcagacggagcatgaacgctatctgacagaggagatctacaagcgtccggtatttgtgacagattatccgaaggagatcaaggcgttctacatgaagatgaacgaggacggcaagacggtagcggcagtcgactgtctggttccgggaatcggagagatcatcggcggaagccagagagaggacgactacgacaagcttctggcgcgcatcaacgagctgggacttcgcgaggaggattatgagttctatcttgatctcagaaagtacggttccgcaagacatgcgggattcggactcggattcgagcgctgcgtgatgtatctgaccggtatgtccaacatccgtgacgtcattccgttcccgagaacggttaacaactgcgaactgtaagagggaagactgaggtggagcatgagatatattttggaaaatgacacgctgcgggtcgagattgaatcgttcggcgcggagatcaagtctgtgaaacgcaaggcggatggaagggaatatatgtggtgcggagacccgagatactggggcagaacatcgccggtgctcttcccgtttgtcggcgcgccgaagaacaaggaataccggtatgagggcagaacctacccgatgggacagcatggattcgcgcgcgatatggagtttactctggaggcacaggaggaaaagagcatctggtttgttctctcctccacagaggagacctatgtgaaatatccgttccggttccggctgcacatcggatatatgctggacgaaaatgaagtttccgttcactggaaggtggacaacactgatgagaagccgatgtatttttccatcggcgcacatccggcatttttgtgcccgatcaacggggaacaggataagacgggctatcgtctccggttcggagatctcaccgacaagctgcatcatcacggcaacacgccggacggcatggcaatcatgacggatgaggagctggaactggaggatggagaggctgtgattacgcccggattctttgacaagtgcacctacatggtggagggagcgcagacgggagaggtgtcaatcctggaccgcgacggcgaagcctatgtgacggtacgctttgatgcgccgctgtttgctctgtggtctccggaaggaaaggaagcaccgttcctgtgcattgagccgtggtatggaagatgcgatgcggttgactttgagggaagcctggcggagcgcccatacgagaatgcgcttgcagccggaggcagttttgatgcagagtacgcaatcgtgtttgcatagccgcatgcgaaccggcatatagataggatagaaagaatcaggcaggtctatctatgaagctgggatacaaaataaaaccgagagatgcaaaaagcaacccgacgacagccatccttgccgccgtgtttgtgatgttccttataagcggtcttctgctgcttcttctggcgcttctcttatataagatggagccgggagagtccgtcattaagatcggaattgtggcggtctacgtaatttccgggctttgcggaggttttctgatgggaaaacggatgcgggagcagaagtttttgtggggactggcggcgggaatcatctattttctgctgctgtttggtgtgtcgctgctcgtaaagggtacgggtgatcttcagatgacgcgcattttttcaacgctgatcctctgcggggcatccggcatggcgggaggaatgttaagctgaaaagccgctctgtggggcgaaagttcagcaaaaaaaaggcttttcatctaaccggtcatgtgctatactatacgggttaatagaattttattgtaagatataaaggagagattattatgaagcacgttaagacattaaataccagaaagttacagaacaccatcaagaagggcggatgcggtgagtgccagacatcatgtcagtctgcatgtaagacatcctgcaccgtaggaaaccagagctgtgagaacagataatttttcacgggcataagtgaatagcattacttacagacgaccgttcgcgaagcgtgcggtcatttgtacgttataatagtcagaattagaaagagaggaaatattatagtggttcatcagtataagaacaacggctatgatattgttctggatgtaaacagcggcgcgattcatgtggtggatgacgtgacatacgatgtcattgccctgtatgaaggacatacaagagaggagattgtgaattctctgcgggagcgctatccggagactgaagtggaagaggcacttgatgaggtgcagatgctggtcgacaacgaggagctttttacgaaggatacctacgagaactatatcatggatttcaaaaagcgcccgacggttgtcaaggctctgtgcctgcacattgcgcatgactgcaaccttgcctgtcagtattgctttgccgaggagggcgagtaccacgggagaagggctcttatgtcctttgaagtcgggaagaaggcacttgattttctgattgccaattccggcaacagacgcaacctggaggtggattttttcggcggggaaccgcttatgaactggcaggtggtcaaggatcttgtggcatacggcagagagcaggagaagcttcatgacaagaagtttcgctttacactgacaacaaacggtgtacttttaaatgatgaggttatggaattctgtaaccgcgagatgggcaatgtcgttttaagtattgacggacggaaggaagttcacgataagatgcggccgttccgcaagggtgcgggaagctatgatctgatcgtgccgaagttccagcagttcgcggagagcagacatcaggataaatattatgtgagaggaacctttacacattataatcttgatttctcggaggatgtgctgcatcttgcagatctcggattcaagcagatttcggtggagccggttgtggcggagccgaaggaaccgtacgcaatccgggaggaggatctgccgaagctcttcgaggagtatgacaagctggcagttgagatgatcagacgtcataagagcggagaagattttaatttcttccactttatgatcgatcttgagggcggtccgtgtgtggcaaaacgtctttccggctgcggttcgggaaccgagtatctggcagtcacgccgtggggtgatttctatccgtgccatcagtttgtcggaaatgaaaagttccttctcggaaatgtcgatgagggcatcttaaatacagacattcgcgacgagtttaaatgctgcaatgtctatgcgaaggagaaatgccgcaagtgtttcgcaagattctactgcagcggcggctgcgcggcgaatgcctacaatttcagcggcgacatctgcggagcatatgacatcggatgtgagcttcagaaaaagcgcatcgaatgtgcgattatgataaaagctgcagaggaggaacaaaagaatgaagaagagtaaagcgattgttattttgatcgtgatccttggtgcactggcgggacttgcttattatgcatccatcattctttcttcgacgggaatcggggaagagatgagcattccgcttggtctggatttatccggcggtgtttccattacctatcaggttgtggatgacaatccgagtgcggaggatatgagtgatacgatctacaagctgcagaagcgtgtagagggctacagtacggaggcgtctgtctaccaggtgggagatgaccgtattacggttgagatccctggcgtatcggatgccaatgcgattctggaggatctcggtaatccgggttctctggagttccagcttccggacggaacggtttacatgacgggtgaccaggttgcggatgcgcaggcgggaaccacgacagacagctacggcaacaagcagtatgtggtacagttaaagctcacagacgacggagcaaagctgtttgcggacgccaccacagacaatgtcggcaattatctgccgatcgtgtatgatggcgagacgatcagctatccgcaggtaaaggaagccatcaccggcggtacggcacagatttccggcatgaagacgtatgaggatgccgagacactggcaacacagatccgtatcggttctctttccttaaagctgcaggagctggaatccagcgttgtaggagcacagctgggaagccaggcgatctcttccagcttaaaggcagcagccatcggattagtgattgtcatgatcttcatgatagtgatgtatcagattccgggtctggcggcagccatcgcgctggcaatctatacctgtctggtaattgctacattatacttatttgagattacactgacactgccgggtattgcgggtatcatcttaagtatcggtatggcggtcgatgcgaacgtcattatcttcgcgcgtatccgtgaggagattgcgacgggcaagacggtcaattcttcaatgaagatcggttttaagaaggcaatgtcagccatccttgacggtaacatcacaacgatcatcgcggcgttggtactgattgcgctgggttccggtacagtcaagggatttgcatacactctgatgattggtattgtactttccatgttcacagcgcttgtcgtgacaagatggatcctgtattccttctatgccatcggtatccgtgacgagaagttctatggccgtgcaaaagagcgcaggacgttgaacttcctcggaaagagaggcgtattctttacagtttccctggcaatgattgcagcgggatttatcggaatgggtgttcatgcagcaaagggaagcggagcattgaactatggtcttgacttcgtaggaggtacttcaacgacagcagactatggcaaggattacacgattgaagagattgagaataccatcgttcctgttgttgcggatgtgatcggcgacaaggacatcatggcgaacaaagtggaaggtacgacacagattacggtgaaaacgcgtaccctgacgctggatgagagagatacgctggagcaggcattggtggatcagcttggagcagatgagtcttccatcacatcacagagtatcagctcgactgtcagcagtgagatgcgttccgatgccattgttgccgtgatcgtatcttcgatctgcatgttgatttatatctggttccggttcaaggatatccgtttcggtgcaagtgcgattattgcgttgctgcacgatgtgctggtagtgcttgcggtttattcactgcttcgtatttccgtcggaaatacctttatcgcatgtatgctgacgatcatcggttactctgtcaatgatacgatcgttattttcgaccgtatccgtgagaacctgggcaggacagcagtaaagcagacgccggagcttctggcggaggttgccaacaagagtttgacacagacgctttcacgaagcatcaatacgtctctgacaacctttatcatggtattcatgttgtttttactcggtgttgcaagtatccgtgagtttgcacttccgttgatggcaggcctgctctgcggagcatattcttccatctgtattgcaacggagctgtggtacatcatgagactgcatcttggcaagaacagactgatcaagaaataaaacaaatattaggggctgcaatacattgaccaaagatgtatttgcagtcctttttattcccctacaggaaaaaggaaaataacgggaagcaggcatgaagaaacgtaggatagcgtgtataatggcatgacgcagagattgaccctgccatatttaccttctggcagtatagtgaaaaagggaagtgtggatggaattgagggagcggtagatctggatgtccagtttgtggagtgacatgaaaacggtcattgaggagaaatgagatggatgggatgaagttgtttgcaatctatttggcggttatgaatgtgctcggtgtggcggtcatgtggtcggataagaggcgcgccagactgcaccggtggcggattccggagaaggtgctctttggcgtgagcctgctcgggggaagcgcgggaacctgggcaggaatgtatttgttccgccacaagacgaagcactggtattttgtggtcggaatgccgctcattctggtttgccaggcggcacttgcaatttatctggtgcacttatatgttttataacaaattgttatagacggtatatgttttctgattgaataaagatacaaagtcatttataatgagtagcatagccgtagaaagacaaatgtttttcgtagaaagacagtgcggcggttcaggaagggagaatacatacgatgtatacaatggaagatatcgaagcggtagatatggaaatcgcacaggcaataaaggatgagtttgacagacagaacagtcatatcgagctgatcgcatcggagaactgggtaagcccggcggtgatgtctgcgatgggaagcgttttgactaataaatatgcggaaggctatccggggaagcgctattacggcggatgcgactgtgtggatgtcgtggaggagctggcaagagagcgcgcgaagaagctgttcggctgtgactatgtcaacgtgcagccacattccggagcacaggcgaatatggcagtgcagttcgcgattttaaagccgggcgacaccgtgatggggatgaatctggatcacggcggacatcttacgcacggttcaccggtcaatttttccggaacctattttcatatcgtaccgtacggtgtgaacgacgagggattcatcgattacgacaaggtgatggagattgccctcgagtgcaagccgaagatgattattgcaggtgccagtgcctacgcgcgcacgatcgactttaagaaattccgtgagatcgcggacgcctgcggtgccgtgctcatggttgacatggcgcacatcgccggtctggttgcggcgggacttcatccaagcccgatcccgtatgcggatgtcgtgacaacgaccacgcacaagactctgcgcggaccgcgcggcggaatgattctctgcaaccaggaagtggcagacaagtacaactttaataaggcaatcttcccgggaatccagggaggtccgctgatgcatgtgatcgcggcgaaggcagtctgcttcaaggaagcactgcagccggagttcaaggtgtaccagcagaacatcatcgacaatgcgcaggcgctgtgcaaaggactgatgaaccgcggtatcaagatcgtatcgggaggcaccgacaatcacctgatgcttgtcgacctgacgaattttgaccagaccggaaaagcggtggagaagcttctggattccgtaaatatcacctgcaataaaaatacgattccgaacgatccgaagtctccgttcgtgacgagtggtgtgcgtctcggtacgccggcggtgacatcccgcggattcaataccggggatatggatcagattgcggaggcgattgccatgatgatcaaggagggagagccggcggcagatcgcgccagagcgattgtggcggagctcaccgcaaaatatccgttaaaataaaatctttcaaagtgtgtagactaggcttccgtgcatattgtgagtgttcaatatgcgcggaggcttttttaatgttctattctacaaaaattattaagaattaaacgctatgtatcgggtctgaaaagatgatagaataaagaaaagaaagtaacccgtctggggcagaggaggagctatgggcaaaaagagcgttggaattctgatcggtgtggcagcagtggctgctgttctgggaggaaccggttattatttccgggatgatatcaggcagatgataccgatctttgatgatggaagttcagaggacaaggtctatgtggaaaaggtatcccgcattatgaatcagtatgcaggtgtttccaaccggtataacggtgtggtggagacgcaggattcatacgaggtgaatgtggattcttcccggacgatcagcgagatcaaggtggaggtcggcgatgaggtcgaggagggacagactctggtcacttacgacaccagtgaccttaccatgaagattgagcaggcgaagctggagctggaaggcatccagaatgagatagataattacaacaaacagatcgacacactgacgaaagagatggagaaggtggacgaatcggaacgctacgattacaccacgcagattcagaatatccagaactccatcgcacagaagcagttcgatatggagagcaagaagcttgagatctccaaggagcagaaacaggtcagcagttcttccgttgtgagcaaggtggcgggagtggtcaaggagatcaatgagaaaggcgtggacagcaacgggaacagcgcgccgtttatgacgatcttacagactggagagtaccggatcaagggaagcatcgatgagcagaatgtctggatgctttccgagggacaggaggttgtgatccgctcgcgtgtggacggcacgaagacgtggagcggaacgatcgggaaaattgacacggagagcccgcagcaggggaacgataacagctattacagcacttcttcggcgggagatacacagtcagcgtccaagtatccgttctatgtggatctcgactcggtggacggactgatcctggggcagcatgtgtacatcgagctggatcagggacaggaggaagtgaaggaaggtctgtggctgtacggctcctacatcgtgcaggacgaagataccccgtatgtgtgggcggctaatgagaaagaccgtctggagaagcgctacatcgagctgggagagtacgatgcggatatggatgagtatgagatcgtatcagggcttgcagaggacgattacattgcctggccgatggctggtctctatgagggtgtgacgaccgtgaccgacgaggcggaagtggattattcttctccgctttacaatcagccggcggacgagaatctgtacgatacagagggtgtctatgacacggaactgctctatgatgtgttggacagcgtctatgatacagaactgccggatgaaatgtatgacggtatggatgccggagaagggacagaggcggaggtggcagaatgatactgaatctgcagaatatctacaaagactatcagcaggagaagctggttgtgccggtgttaaaggatgtatcgctgacggtcgaggaaggagagtatgtcgccattatgggaccgtccggttccggtaagaccacactgatgaatattatcgggtgtctcgaccgaccgacgagcggtacttacgagctggcgggggagaacgtgctcaaattaaaagacagggaactctcggatctccgcttaaagagcatcgggttcgtgttccagagttttcagctgatgccgcgggagagcgccgtggaaaatgtggcgcttccgctcagctacgccggagtgcgcaaaaaggagaggcggatccgcgcgacgaaagcgctcgagagagtgggactcggggatcgtgtcaatttcagaccgacacagctttccggcggacagaagcagcgtgtcgccatcgcccgcgcgatggtcaaccatcctaagattctgctggcagatgagccgacaggagctctggactccaaatccggcgagcagatcatggagctttttgacagcctgaacgaagagggcgttaccatcgtcatgattacgcatgatcccaggattgcggcgaaagccaagcggattgtccggatcatcgacggtgagatctatgagggagagggggacggagcggtatcatgaagattaagaaagtgattgcggtcatcgcaggtattgcggtcaccctctcggctgcggtgggaggcgtatacgggtataagtcctatcaggacaaaaagcttatcgcggaagtgcagccggtttccaacctcaactggggatactggggagacacggagacaagttatggcaccgtcacgaacgattcctcacaggagatctatctggatgattccagaatgatcaaggagatctatgtggagaagggggatgaggtgcaaaagggagacccgttgctcgcctatgacacggcggaactccagatagagattgaacgcaaaaaactcgatatcagcacgatcgagaataacatcgagagacaaaaatacaagtatgaaatgttaaagacgcagacgccggtgaaaaaagatccgccgaagctgaacgaggagcagcttgcctggtatcagcacatggacgaggaaaaccgcctgacagagacagataagaacgacagcagaatctacaactatctgacggcggcctccattccctacaacgtgacaaccaatgcggcgggggaactggtgtatccggcaggaacagcggaagaaccgtatatttattatgtcaaccagaatgcatacgcctacggcggctttttcaatgccatccgtcctaccgcggagggaggcagcggaaaacatgtgcgcgtgatcgtctgcaagaaggatgcggacggtaagatggtgcttgacaccgatgaagcgaccgggcggcagacgccggttgcggatgatacagtgtccccgaataccgtcgagttaaacggcagcgattttccggcggattacgatgagagccgcatgtggtatctgttttcgggaaaagaatacataccgacctcccttgcggatgagtacatgcaggcctacgaggattttatggcggactgggaggtgccaaagggatatacttccgaggaactctatcaggaggctgccgagattgaagaaaaattaaagatgctcgatattcagcgcagacaggaacagctggcgctcgagtccatggagaaaagtgcgacggacggtgtggtctacgcggaggtggacggtgtcgtcaagacgctcggtgatccggacgagaagcccgagcaggggcaggcgtttctggtgataaccggagatgacgggctctatgtaaaggggacgatcagcgagctgcttttggatgatgtgaagatgggaaccgtggtgactgccaattcatgggagagcggcatgacgtttgatgccacaatcacggaaatatcggattatccggtttcgggcaactcgtggggcgatggaaatcccaatgtctcctattatgagtacacggcttatatcgaggacagttccgcgctccgcaacggggaggcggtagatctgtccatatcgaccaatcagtccgatggcggcggcatttttatagaaaaagcgtatgtgaggtcggaggatggaaaggcgtactgtatgattgcagatgagaataaccggctgaaaaaacagtatgtggtgaccggaagaacggtgtacggatctgcggtagagatcaagtcgggtctgacggaggacgaccgcatcgcattcccgtacgggaaaaatgcggtggagggcgctgccgtcacggacgaatcatccaattattaaaggaggaacggagatgtttgaaaatataagattatctttccgcggaatctgggctcacaagatgcgttccttcctgacgatgctgggaattattatcggtattgcagctattattgcgattgtatctacaattaagggaacaaatgagcagatcaagcagaacctggtcggagccggtgagaataccgtcgagatttccctgtatcagggagagtgggaatatgagatggagtacaacggcataccggagggcgtgccgcttgtggcggatgaggtggttgaacagctcaaggagatcccgcatgtggaaaatgtgtcgcgctatctgagccggcaggattacaacggagtctatcatctgaataccgggctttccggtggttatgtcaagggcgttgacacggcttattttgacacctgcaattatattatgaaggaagggcgtgggttcacgcagcaggattttgaccagtatcacaaggtcgcgattctggatgaggattcggcggacgcactgttccagggagaggaagctgtcggggagacgattgagattcagcaggagccgtatgttgtggtgggaattgtgacaaaggcgaaaaagtttgaaccggtcatcaactcaattgatgactattatacctacgcgcaggattccgccggctctgtgtatgtgccggcgacgacctggccgatcatctatcagtacgacgagccgcagaatgtggtgctgcgcgtggagagtacggatgatatgaccagcgccggaaaagcgggagcggatctgctaaacgggtatctgtcggtgtcggatacgacgatccagtataaggcaaaagatctgatggagcaggcacagcagattcaggaactcagcagctccaccaacaccatgctgatctggattgccggcatttcattgattgtcggcggtatcggcgtcatgaacatcatgctggtatcggtgacggagcggacgcaggagatcggtctgaaaaaggcgatcggggcacgcaagtcccggatcctgggacagtttctgacggaggcggcggtgctcaccagcctgggcggtctcatcggcgtgctggtcggcattattctggcgcaggtgatctcgtatgtgacgacgacgccggtggcgatcagtgttccggcagccgtgggagcggtggcgttttccatggttatcggaatcgtattcggtgtgttcccgtcctacaaggcggcgaatttaaatccgatcgatgcgctgcggcatgagtaagcaaaaaataatgacagcgctgcggacagaaaggagccggcatgataaaaagaattgtcatgatggagggcggagtggagacactatcctacttctcccatcagatggcaggagagtttcaaaaactgggatacgcagtatttttctatgatctaaaacaggaggagagcagcgctggaaagctgcgcaagtttatcagaccgcgcgagacggtgcttgtgaccttcaattttcagggactggaaaaggaggcgggcgtgtaccgcgaggggatcggttatctctgggatacctatcatattccctgttataatattgccgccgaccatccgtacttttacgatgacaggttaaaagatctgccggaaaaataccggcatatcagtatagaccggagacagaaggcatattttgaagagttttatccggagtatgtgtcgcgtggctttctgccgcttgcgggaaccggattgcggcaggcagaagaggaaggcgaagctgagcagggaaaagcgcgagcgcagggcgccgcagttgagacgggagaaactggagcgcagggcgcagcagaacaggcggcgtcctgctatgacgtgatcctgaccggaaattacacaaagctttccttttttgaaccctatatcaactggatcaatgaggagtacgcggcattttaccgggggatcatagacgatctgttggaacatccggcgtgcacggtggaggaagtggcgcttgcccactgcgagcgggagatggggaaagagcccaatgatcagctgcggattgccctgcataagatgattttcattgatctgtatgtgcgcaattactggcggggaaaggcggtgcgcacgctcgtcaatgcaggaattccggtacatgtggtcggaaaaggctgggaggaactggaggatgtgagacatccggagtgcctgaagctgcacccgcagaccgattccgttacctgccttgagatgctggcggacgcgaaggtgtctttgaacgtgatgccgtggtttaaggacggagcgcatgacagggtgtttaattccatcttaaacggagcggtatgtgtgaccgatccgagctgttacctggaagaggaacttcatgagggcgagggcgtctgctatgttgcgctgcaggatatggacgctcttccggaaaaagtgaaggatttattgcaaaatgattccgggaggaatgagattgtgcggcgtggcagagcgattgtggagcagaagcatacctgggcacagcgcgcgaagacgctggcagcgtggattgcggaggacgccgcgcaatagataaaggacaaagtgcggaaaatacaggggattcgatgcggactgggcgcggatcgggcgaatctgcatattaaccttgcattttgcggataatcattatataatagcggaagaattggcgatgaagaaagctgcggtttgaagactgcgacagagagccggtgggtggtgcgaaccggtgcaggatagaatctttccacttttggagccggcagtgaaagctgcgagggtcgtatcctttaacatacgtttgagaggtcgcaggaacatgcctgtggcaagatgggtggcaacgcggaagcagaacctttcgtcccatgtgcaagtggtgcccggtcagagatggcggggacatttgacacaggggcgaaaggttttttgttcctgtgcggatagaacagaagaatttaggaggaaatgacatgatcgatctgaagtttttgagagagaacccggaggttgtaaagcagaacattaagaacaaattccaggatcacaagcttccgcttgtggatgaggtaattgaactcgatgccgaggcgcgcaagacacagcaggaagcagacgatcttcgagcaaagagaaaccagctgtccaaagagatcggtaaactgatgggtcagggcaaaaaggacgaggctgaggctgtcaagacacaggttgcagagggagctgcccgtctggcagaattagaggaaaaagaaaaggaacttcaggagaaagtcaccaagatcatgatgacgatcccgaacatcattgatccgtccgtaccgatcggcaaggatgattcctgcaatgtggagatcgagaagtttggcgagccggttgttccggattttgagatcccgtatcacaccgagatcatggagcgttttaacggcattgatctggatgctgcaggcaaggtggcaggaaacggattttattatctgatgggcgatattgcgcgtgtacactccgcagtgctctcctacgcgagagatttcatgatcgaccgcggttttacctacgtggtgccgccgtttatgatccgcagcaatgttgtgacgggcgttatgagttttgatgagatggatgccatgatgtacaagatcgagggcgaggacctttatctgattggtacctccgagcattccatgatcggtaagttcatcgatacaatcaacgatgaggagaagctgccatatacactgacatcctactctccatgcttccgcaaggagaaaggcgcacacggcatcgaggagcgcggtgtttatcgtattcaccagtttgagaagcaggagatgatcgtagtctgcaagccggaagagtccaagatgtggtacgataaactgtggcagaacacggttgacctgttcagaagcctggatatcccggttcgtaccctggagtgctgctccggcgacctggcagatctgaaagtgaagtcctgcgatgttgaggcatggtctccgagacagaagaagtatttcgaggttggaagctgttcaaacctcggcgatgcacaggcgagaagattaaagatccgtgtaaagggcaaggatggcagcaagtattttgcacataccttgaacaacacggtggttgcgccgcctagaatgttgatcgcgttcttagagaacaacctcaacgcagacggaagcgtcaatgttccggtagcactgcgtccgtatgtcggaggcaaggagaagctgattccggtaaaataaatatgcacaaaaaacggtctgccggatagggcagaccgttttttttgtgttatttatttgcacttcggagaattgcattagcacttctctggttccggatactccacaccgaacgtttcgacagtcacttttttcatgacctgcggagcgagcgggcggtcgctatagtcggttgcagtctctgcgatcttgttgactacgtccatgccttcggtgatcttgccgaatgcagcgtatgcgccgtccagatgcggggaagtcttatgcatgatgaagaactggcttccggcggaatccggatgcatggctcttgccatggaaagaacgccctctgtgtgctttaagtcatttttgaaaccgttctgggaaaattcgcccttgatatcgtagcctgggccgcccatgccggttccgtccggacagccgccctgaatcataaagccgttgatgacgcggtggaagatcagtccgtcatagtagcctttctggatcaggctgataaaattgtttaccgtatttggtgcgatctcaggatagagctctgccttcatgatatcgccattttccatctcgatagtaacgattgggtttgacatagtatacctctttctgccctgtatgcgggcgggtgaaataagaagcagcctgctgtgacagcagtcatccgccgcctctacggcactattgtagcgaaaaagagcggattcgtaaagagaaacgatggaatttccgaaaaagtcttgccctgcaggcaggaagagtgtaacattaggtagattcaggaatgctattttgaaggaaaaattgcaaatgaatatgaaaaatataatcaagaataaacaaaaggaacttatgcagggaatgattgcactgatattatgcgtggcgttattttgcagtgcggctgtctctgggaaaaatgacggatctgagtggaaaatgcgccatggcgggcagaaatatgaggagacgggaactgatggtcaggtgcagacaccactatatgcaggaattcttgcagaatttcgcgcgaatgagatggcaattttgtcggacaaccaggagattcttgcgaaagcagcagagcgggcagcggaggaggcggcacatccggaacagggcgtctacacatttttacagggaccgaagtcctggacagagggacgggcatggtcgggggagtggtcgaaccagtatgtcagaggcaattacttcggcaatttcggatgcggtctgtgctgtatggcaaatatctactgcacgcttacggagtatacctgttctccgtgggacatgtacgaatatgcgaggcaggtgtccggctatgcaccatcgcggaagatcggggcaatcggctgggcggatatgaaagttacattgcgaaaaagcggttttgactgtaccctgaacacaaaaccggaaagctatgagcagttccagcaggagatcacggcgtcacagatggcggtggttctggtttccagcagggacgatgatacctactggaagaagacgggagggcattatgtgtcgatcagcctttacgatgcgtcgtcagatcaggtgttcctcggggatccggcggatccggacggcaaccgctcctggattccgctgcgctacgtgtatgacgcattaaaaaccgtcagccagtatcagtatcttctggtacaggattatgcggaggaacagaatcagtggatgcatgacgggattacggatgcatggggaggaatgtaatatatatttgacatattgtaaagcagatgctaccataaaagaagaaatcagaaactatcaggactgtgtgacaggaaatgaaacaggaggattggaagatgaaagaaaatgtggcgtatctgcttgggattgtggcagggctggcggcggtaggaattatctgctgggtgaagaaacggggacgcagggaggctgactatgatgagcggcagtatcagacgcgcgaccgcgcctgccggtacggttttctgatgctgctgttgtatgaactggtatatggggcattgtatatgaaagaagcgccgtcctggtgcgactatacgatgggaaattatctgggaattggtctggcactgcttgtgttcggcgtatattgtatctggaacgatgcttatatgaacctgaaccagaagccgtggagcgtacatctgctgtttggagtgctggcactgtgcaatcttggaatcgcggaaaataaccagcggatcggaacgctgtttgcggacggaaaactgggatttggcgcggtgaatctggtgtttgcagtgatgtttattgtctttgaaattgttttttttataaaaagaagccgggagaagcgggatctgtcggaggaaaaagctgaatgaaaaatctcaggttaaaagcggcgcgcgcggcaaaggatctgtcccagcaggcgctcgccgagaaggtgggagtgtcgagacagacgatcaatgccatcgagaagggagattataatcccacaatccggctgtgcattgcgatatgcagggagctggacaaaacgctggatgaaattttctgggaagaggaagaatgttaaagttagaatatattttaattggaaagctgccaaagacagagcgtgacatgctgctggagaatctgagaacagagcgggaatgtgggcggaacgttttggaatgggacagcgcgaagaaacacattcaggaaggggcgcttgcggaaaaggcaattttggtctcggaagatgcgaaggaactaagcgaggcacagcggatcgggatggctgcgctttgctatttgatgccggaggatggaaggacgcagagagaagagaccgccggggagatggaagtgacgtctccggcggatatgtatgcggaagggatggaggagatcgacggatcttttttacagcatgtctatgagagacatcatcgtattccgtggatcattttaaaaacgccgcgctgcatcgtgaaggaattttccatggaatacttagatgcactgtttgaactgtatgccgggaaaggaatgacggactacatggagccgctgtatccgtatgaggaggagcgggaatatcagcaggcgtatatcgagcagatgtaccggttctacggatacggcatgtggatcgtgtgcgacaggaataccggagagctgatcgggcgcgccggcgtggaacaccgggaggagctgggcggagagctggagctcggttatgcgatcggtgtgccgtggcagagacagggctatgcgacggaggtatgcagtgcgattcttacctatgtaaaggaggaactcatgctgccgtcggtcagttgtctgatcgaggaggggaacgtagtatcggagcatctggcgcaaaagctgggctttcattactgtgaaacggtgcagatagatggaaaacagatgagaaaatacaaagttgcattttattaggaaataaaatataatattgaaataaaaattatcatggatgaagtgggtgaggcacatggcagattactctcagaaagaaaaagaacttgagcgtgagcatttggaaaaactggtaaaggaagaggaccgcagtatcaagccaatgaaggagtttgagagtccggaggatttgtatcatgagctgatcgccagtgtgcgcaaatatcacccttccgcagacatttctcttattgaaaaggcgtatcatgtggcgcgggacgcgcatgagggacagacgcgcaaatctggtgagccgtatattgtgcatccgctgtgcgtggcgatcattttagcggagctggagcttgacaaggagacgatcgcggcaggtctgctccatgatgtgcttgaggacacggtcatgacggcggatgagatcaaggaggagttcagcgaggaagtgctgcttctcgtggacggcgtgacgaagttgcgccatctgcatcttacggacaacagccataatcacgaccagaaggaccgctctgcggagcgcttagagatgcaggcagagaacctgcgcaagatgttcctcgccatggcaaaggatatccgggttattttaatcaagcttgcagaccggcttcacaatatgcgtaccttaaagtaccagtccaaggaggcacagatccgcatcgcgcgtgagacgcaggagatctactgcccgattgcacagcggctcggtatttcaaagatcaagattgaacttgacgatctctcgttaaagtatctggagccggaggcatactacgaccttgtgcgtcagattgaccagcgcaagagtgtgcgcgacgactacgtgcagtcgctcgtggaggaagtgcgcgcgcatatcaaggcggcgggaatcgtggcagagattgagggacgcgcgaagcattttttcagcatttataagaagatggtgaatcaggataaaacgctcgaccagatctatgatctgttcgccatccgcatcatcgtggattctgtcaaggactgctatgcggcgcttggtgtgattcacgagatgtacaagccgatcccgggccgttttaaggattatatcgcgatgccgaagccgaacatgtaccagtcgcttcatacgacgttaatcggaccgaccggacagccgtttgagatccagatccgtacctatgagatgcaccggacagcggaatacggtatagcggcgcactggaaatataaggaagcgagcaacaacggcggcgcggcagtgccgatgactgtcacggaggaggagaagttaagctggctgcgccagatcttggagtggcagcgcgacatgtctgataataaggagttcatgagccttttaaagagtgatctggatcttttttcggacacggtattctgctttacaccgaccggcgatgtcaagaacctgccgaacgggtcgacgccgattgattttgcgtacagcattcactccgcggtcggcaacaaaatgatcggtgcaaaagccaacggaaagctggttccgatcgattatgtcatccagaacggtgaccggatcgagattatcacttcgcagaactccaagggaccaagccgtgactggctgaacatcgtaaagagtacccaggcgaagaataagatcaaccagtggttccgcagtgagctgaaggaagaaaatattacgcgcggcaaggagcttctcgtggcgtcctgcaaggcgaagggaatcaactttgcagacatcaacaagccggaataccaggagaaagtgctgagaaaatatggtttccatgactggaattcctgtctggcgaccattggacacggcggcttaaaggaaggccagattgtcaataagatgtacgaggaatataagcgggatcatctggcgcggatcacggacgaggaggttcttgagaccatcggttccgagaacaagaatccggagtcggcgaagcgctccaagagcggaatcattgtcaagggactttacgatgtcgctgttcatttttccaagtgctgcagcccggtgccgggagatgagatcgtgggttttgtgacgaggggacgcggcgtgtccatccacagaactgattgcgtcaatatcatcaacttgtcagatatggagaaggagcgtctgatcgatgcggaatggcagcatgacggtcaggacggcagcaatggtctgtatcgcgcggagatcaagatttttggtaacaaccgtaccggacttctggtcgacatcacgagagtgttcacggagcgtgagatcgatattgatgcgatccactccaagacgagcaaacagggcgtggcgacgatcgatgtgtccttcagcacgaagggcagagaggagctgggcagcgtgattgataagctgcgccagatcgacagcgtgattgatattgtgagaacgacaggctgatgaagcaggaaaggcagacggagggaaaaagatggcgcctcttaaggtagaacagtatgtggtaggaccggtgcagacgaactgctatttcgcggtcaatgatgagacgaaagagatgattctgattgatccgggggcaaatgcggatcgtctgatacggatcatagaggaagaaaagttaaatcctgttgcaattttattgacacatggacattttgaccatgccgggggcgctgcggaagtcgcagcgcattttggtatcaaggtctatgccgaggagcatgagagagagaccctcgatgatccaaagctgaatctgagcggatggacgggagcggagacgacctatcgcgcggatgtatttctgaaggatgagcaggagtttgatctcgcgggattccatatccgggtattgtttacaccgggacacacggtgggtggctgctgttattattttgcctatcaggacgcccttttttccggggatacgctgttcgcccagtcggtcggaaggacggattttccgaaggggagcgcttcggcgctgattcgcggcatcaaggagaagttactgccgcttccggatgaagtgaccgtctacaccggacataatgacaccacgacgatcggaacagagcgcagatacaatccatatctgtaagcgtatgatccgggaaaccagaggttttccggacttttgccgaagcaaagacgcatatgatataatgaatcctatcggattcatattagaagttcctgcggaacttcggatgcgcagaaagcagcgcaaaaagatgatataatatttagtttagaaaagagtcagatatgatagaagtaacattgaatcaaccggaatttgagtacgatatccattcactcatcaaggcattttatccgtcggaatacgtcggagtatccgcggaaaagaaggagtatgacgagccggtgacatcccgcatgcatgtggagtacacggacgatgcgataacgctgcgctggcagcagggagagacggcgcctgcggtggagcgtacctttgcagtcgatcctttagaccgcccggagacgaagaaccggctgaaacagaatctgtatgcgcttctgtcggatgcgaccggtcagtatctgccgtggggaacgctcacgggaatccggccgaccaagattccgatgaagttgctcgaagagggaaaaagccgggacgagatctatacgtatatgaagcagacttattttgcgtcggatgagaagatctgccttgcgacagacattgcagagagggagctctccctgctttccaagatcgattatgacaacgggtacagcctgtatatcgggataccgttctgtccgacgacctgtctgtattgctcgtttacctcctatccgattgcatcgtgggcgaagcgtgtggattcctacctggatgcgctggagcgggagattgagtttgcggcggtgaagtttgcgggcagacatttaaattccatttacatcggtggcggtacaccgacgacgttagaaccttatcagctggacagactgattcggaaaattaaatgcagttttgatttatcagactgcctggaattcacggtggaagcgggaagaccggacagcattacatacgaaaagctgaaggtgttgagacagcatggaatttcgcgcatctcgatcaatccgcagaccatgaagcaggagacattaaagctgatcggcagacatcacacggtggagcagacggtggagagttttcacatggcaagagaactcgggtttgacaatatcaacatggatctgataatgggacttccggaagagacactggacgatgtgcgccggacgatggagcaggtggcagagcttgcaccggacaatctgaccgtacattcgctggcactcaagcgggcagcgcggctgaatatgttcaaggaagattataaggattacaagatcatcaacacgcaggagcacatggatctggttgcggactgtgcggcgcagatggggctttttccatattatctgtaccggcagaaaggtatggcgggcaatctggagaacgtcggctatgcaaaagagggcatggcgggcgtgtacaatgtgctgattatggaggagaaacagaccattgtggcatgcggagcgggagcttcgacaaaacgtgtctggacagagccgaatccggatggcacgcaccggattgaacgtgccgagaatgtcaaggatgtagcgcagtatatcgcaaggattgatgagatgatacagcggaagcagaagctttttgcagaagaataaaagggttattcatcctgaaatagtacatcaaaaaagtatccaataatacggaataacctgtgagatgtattgaaacaacctaataactgtgccttaaaggacgaattcattttagcagatgagttcgtccttttctgttatagtcaattattctaggagaaaaagaacatgaataacacagcgttaggagcaaaatgagccaatgaaagaagtgtctacaataccttctttggaaagaagtaacacctgagttttcgtgatttcagagagaatttcattattgaaatttttcaggaagagtttcatgacattccagaaaatttgaaatatggggaaatatcacaaaaatcgaatgagaattttgtggcgggttacacgtttaacctttgtgaaaactatatttctattgtaatattgaagcagaatattacaaatcagtaatcaatgtgatgtagaacaaaggagaaaacacatgaataaagaaatgaccgtaaatgggaaaagctatacaataattaaattgctaggaaagggaaaaggtggatattcttatttggcagagtctggaaataacaggtatgttttgaagcagatacatcatgaaccttgtgattattatcagttcggaaacaagcttgaggcagaaatcagggattacaagaaattgaaagagatcggaataaagatgcctgccatgcttgaagcagatgtgaaaaatgaacgcattttgaaggagtttattgacggcgacacgatttatcagttggttttagaagacaagatgaaaactgactatatcgagcaattgcatagaatgtgtgcgctgttatatgctgccaatacaaatattgattattttccaacgaattttgttgtaaataacgaagaaatatattatgttgatttcgagtgcaatgattacatggaagaatggaattttgaaaactggggtgtaaaatactggtcaaagacaccggaatttttgcagtatgtgaaagaacattcatgatactcggaagttgaaggagaaatttatgcaaaagagtataaattatatttgccagataataaactgttacagaaaaagctaaaagaatggctggatgaagaacagaattgattcagaggggagagtgctatctgctgggatagtattctcgggagtatcccaaaggacatttctaattacttagaaatgtcctttttcgcatttgtgaatggtcattgatgctacagaatgtcagaatttacttgtttgcgctgtcagcatcaatcacagactggatctgcttcatcaaagcatcatagttgtcctggttatcgattccgccgagcataggttcgcctattatattaccatttctatcgactaaaattgttgttggaaatgccataatatcagcagcatatttaccggcggctgaatcagagtcaatggaaagattgcgataagcggcgccctggctttcaaggattttttttgcttcttttatagcagcttcattttcatcaaaagtttcggtgttaataccaataacttcgccccccattgatttaatagcgtcatttaattcgttaagtttagataattcagcaacacaaggcttacagccggtaaaccagaaatttatgacagttacggcattcccggaaaacaaattctgatcaacggcattgccatcaaaatcttttccggagaaattctggaaaggggctgtatcatcggaatcatttttggcgccggaagtatcggatacagcattttggctttcaatttcagtgatctgttcttcgattttacgaatggtcttaatatcatcggtaagagtttttaactcgctgtctgtaaacgaagtcttgtttgcttcgacagtatcagcaagataatcagcataatttccatctggatcagcagtacttttattcatcatgccaaaaaccttgtcccatacatctttatgatctgcaaagatctggttttcctgctgatataaatcatcaagcgctgcattggagtcatcggcagatgattcgctggcggatacagcagcagtattctgcgtgttctctgtttttgaagtctcctgcccggcacatccggtgattgataatgcggtacagagtgtaaaaagtgcgataatgtttctttttgttttcatgataaatactcctttaattgataagaattaaatagctgccggctggctattgctggttattgagattgctgctacatgttttttccataaactggtaatggattgcatcctttggacaggctttcatacaggcgccgcatcgtatacattccggatgatttggagtcttacggacatcgacatccattttgcatgcacctgtacacagaccgcatccgacacatttactgttttcgaccttgatgttgagaaaggatattttattaaaaagtgaataaattgcaccaaggggacaaagccatttgcaaaaaggtctgtaaaacaaaatacttaagacaataacagtaattaaaataaggcatttaaaagaaaacagcctgccaagtgcagatcgtatggcggaattcccgagggacagaggtatggcaccctccaaaacgccctgtggacatatgtatttacagaaaaacggatcccccattcctatggagttcgtcacaagcatcggcagtgctataacgaaaacgataagaatgatgtacttcaggtatctcaaaggctttagcctggccgtagaaaattttttcccggggattttatgaagcagatcctgaaaccatccaaaaggacataaaaatccacatataaatcttccaagtgtcacaccgagcagaatgaaaaagccggttatgtagtacgaaaatttaaaatttgaggatccgacgactgcctgaaaagctccaattgggcaggcgcctgcagctgcagggcaggaataacagtttaatcccggcacacatactgttttggcatttccctgatatatttttcctttaaataaatttggaatatgaatattggtaagcaatgtggcagctgcctgaatccacccgcgtacccgggctactttttttgatcgtatagttgtttttttatccaattcccacacactccagacataatttaattgctttgccaagcacggtagctgcttcgcctctgattgcaccataaccgatcataagtgtaccggtgatgaataaagcgaactgtgatattcttttccgcatcagacagattactcctttcgtttgctgttattgtctttgttgaccagctgacagtagtattatacaatagtggatgtaaaatccttgttaagaagcgggagaaatattttgagattattgattgttgaagatgaaaaagaattgtgtgatacaattgcaaaaagtctgtatgatgcgggctatgaggtggatacctcttataatggaagcgaggcgcttgaatatgtcctgacggaggaatatgatctcattgtgcttgacctgaatttaccgggcatagatggaatggatattctaagggaactcaggcgggagaatgaggagacaaaggtgctgattctgtctgcgcgaagccagatagcggataaagtggaagggctggatgcaggagccaatgattacatggaaaaaccatttcatctgcaggagcttgaggcgcggatcagaagcctgacaagacgtaaatttgtacagagagatgtttgcctgaacaatggggacataaggttcgatacaaaaaagcgcgaggcatatgcaaaagaagagagggtgcctttgaccagaaaagaaagtggaattttggaatatctgcttcttaatcagggcagaccggtaagccaggaagaactgatagagcatgtatgggatgcatctgtggatagttttagcggagctatcagggtacatatgtcttctctcagaaaaaaacttaaggcagtgctgggatatgatccgattgtgaacaaggttggtgagggttataagatgcgagaggaatcagaacaatgaaaaaaatgtcacttcagtggaggcttacgatcataactacattgtttattgcagtcatatgtggatgccttaccctgtttgtatataagaacggtgtgtattatattgatttgctgcaggatactgttgatgcccagagtgatgaggacaacagtgaggaggctgatgaaatatatattaatattccagatgataaatgggatgattttgcagatgatttttccattcaggtatataacaacaaagcagattataaaaaaagaagcttgctgttctctacactgcttgcgcttcttggaggtgttgccacatattttctaagcggacatgtacttaaaccgcttagaaatttttcagataaaattgagaaagtgcaggcacaaaatctggcagattcgaggatagaagagaatgaagttaaggaattaaaccggctcagtgtttcttacaacaagatgctggaacgcctctcagaagcatttgaggtacagaggcaatttacggcaaatgccgcacatgagtttcgtacaccgttgtcgctgatgcaggtacagcttgatttatataattcgatggagcacccgggcaatgacgaatgtgcggaaaagacaattgccatgatgacggagcagaacgaaagactcagcaggatggtaaagattcttctggatatgagtgaacttcagattgtggtacgtgatgaaaaaatcatggttgatgcacttgtagaagaggtcctgacggatctggaaccacttgcaatggagaaaaatataaggcttattggaaaatgtaaggatgtaactatggtgggaagtgatatccttatttacaggctggtatataatcttgttgagaatgctataaaatacaatcgtccgggtggacaggttgttgtgatggcggagtggaaagaaaaacatgtttttctttccgtagaggatacaggaagcggaattccagaggaactcagaaaacgggtatttgaaccattctttcgtgtggataaatccagaagcagggaactggggggagtaggccttggacttgcgctggtttatgaaattgtgagagtgcatgatggcaatattgtaatcagggacaatccgtctgggggcacagtttttgaagtgattttttaatgacaggatcatatttgtgataaatgattgcatggtccttgatgcttgacgtgcaggaatacaaaacgtataataatcggaggatataaggcagaaaatggaggaacgctcatggcattaagcaagaagccggtcaacggcatgaaagatattttaccggaggagatgcagatccgggattacgtgcagcaggtcatcaaggagacctaccgcagttttggattcacaccgattgagacaccttgtatggagaacattgcaaatctgagcaataagcagggcggcgagaacgagaagctgatcttcaaagtgatgaagcgcggtgagaagttaaagatcgcagaggcaaaggaagaggcggatctggtcgattttggaatgcgctacgatctgacggtgccgttagtccgtttctatgcgaacaacgccaatgatctcccgtccccgttcaaggcactgcagatgggcagtgtgtggcgtgcagaccgcccgcagcgcggacgttaccgccagtttatgcagtgtgatattgatattatcggtgagccgagcaatctcgcggagatcgagctgatccttgcaacgacaacgacgatcggcagactcggattcaagaattttgagatccgcatcaatgagcgccgcatcttaaaggccatggcagcgtacagcggtttcccggaggaagaattcgataccgtattcattattctggacaagatggacaagatcggtcttgacggcgtggcggaagaacttgccaaggaaggctatgcgaaggagtcgattgacaagtatctggcgctgtttgagggcgtatccaaggcacagaacggtatcaaatatctggcagacactttacagggctttttggagccggaggtggagcagaatcttcaggagatcatcgacagtgtggaggcggcaaaaacagccgactttaagatggtattcgatccgacgctcgtacgcggaatgagctattatacaggaacgatttttgagatcgcaatgccggagctgggagcagcgtgcggcggcggcggacgttacgacaagatggtcggcaagttcaccggaaatgacgttccggcgtgcggattctccatcggctttgagcgcatcattcttcttctgatggagagcggtttcaccgtgccgatgcagcgcccgaaggtagcatacctcattgaaaaaggctgtacctcggagcaggtatcgaaagtgatcgccagggcacaggaggagcgtgttgctgggaagcaggtgcttgtcgtgcgcatgaacaagaacaagaagttccagaaagagaagctgacagccgagggctacaaggacattgtcgagttttacaaagactgatccggaaatgatctgacagagaacgccataggatgatctatggcgttttttacataatgggaaacttcgtttctattacataaaaaagcttcgcgtggatgtgcacgtttcttaaaggagattacgaacggtataaagtaaaaaaagagaaacagcttgcagatggagggcatatgggaagaattatcggtattgatcttggaacgacaaacagtgcggcggcagtgtgggaaaatggagagagtcatctgattccgaatgcgtttggagactatctgacgcctagcgtagttagtataggcaaagatggcacggtgtacgtgggaaaaattgcaaaggagcgtctggttacacacccggaggatacagtaagcgtttttaaacgatttatgggaacggaaaagatatattcgctcgccggaaaaaaataccgtccggaggaactttccgcgcttgtgttaaaaagattaaaggaagacgcggagcattatctgggggaggagattacggaagcggtcatcagtgtaccggcatattttaacgatcttgcaagaaatgcaacaaaaaatgcgggggaactggcaggatttcatgtggagcgcatcattaatgaaccttcggctgcatcgttatattatcagtgccgaagccagatggaggatgccgtcatgctggtgtttgattttggagggggaacgctcgatgtgtcattagtagagtgttttgataacattgtggagattctggcggtcagcggagacaatcatctcggcggcagtgattttgaccggttgattgcagatatgttctggaagtcgtgcggactttctgaaaaccgcttctcagctgaggatgcggcaattgtgttggaacgtgcggaaaactgtaagtttgaactgaccggtcaggagactgcacagatgtgtgtgacacttgctgggagagaatatcggatggaggtctccagaaaggagctgatcctgcaggcggagccgctgtttgaacggatggcacaaccgatccggcgtgtgttgtcggacgggcagaagagtgccagagaagtagatgcggtagtgcttgttggagggtcctgtaaaatgccggtggtgcaaaagtatttgaattatctgttgcagcgcacggatattgcggttgtcagcccggattatatgattgcgctcggcgcaggagtgtatgcaggcatcaaggaacgcaatgcggatattcgcgatatgcttcttacggatatctgtccgttttctctcagcgtgtcccaatacaacgaagcagatccgaaccgtgatctctgtgatgtgctgattgagaggaacatggcgctcccggtcagcagggagactattatgacgacggcacatgacaggcagaccaaaatgaggtttaaagtataccagggggaagcaatgtacgcggaggacaatctgctgttgggaagcatcacggttccggttcctgtcggaccggaaggaaaagagaaggtgcgggtgcgttatacctacgatatcaatggaattctggtggtagatgtgcacgtcgtatcgacaggacaggaaaaacagctggtgatccggaatgataagatcaaactatcagaagaggaactgaaaaaaagactggagcagttgaataaactgaagattcatccgagagatcttgaggaaaacaggctggtgcttgcgcgtgctgaaaagctgcatcgtgagacaacgggatatatccgggaacagattgatagtcgtgtacagtattttaattattatctgggaagacaggatgtcctctccatcaacaagggcagaaaacagctgaatctgtttctggactatgtggaggagcagtgtctgcaggagacggcatttgagggaacagcagacggtttttcccggtggtatgagagtagtaagcaggcggtcgatgcgcaggatcaggcggattaccgcaaagaggaacaggaatatgaattgtggaggggcggacatctgaccagctagaagaatatgacaatatgggagatactgggaatttcccagactacagatcaaaaacagatcaaaaaagtgtatgctgccagagtaaagagttgtcacagggaggaaaagccagaggagtgggcagtgcttcacgatgcttaccagcgcgccattcaatacgcgaaaagacaagagaaagaaagtgacctgaacggaagcaggacggttccgagtccggtgaaaccggtggcacgggaaggtataagagagcgggacgcggcgctggagaaggaaaacggacagcctgaaaccgatgagacagaagcacaatggcaggagtattttgcacgcattcgtgccggacaggagagaagcaggaaaatgctgacagaggagttgccggagcggctgcgaggtctcacattgcagggggaaggaacccagaagaaacgctgggaagagttcctgcaatcggagttggcgattaccctgtacaaagaaccagagttctggagacaagttggtgaacatgtgagggcacaggagtggtcggaggaagcatgccgctacataggcagacgcgtggaagacataaaatatgagtttaacagtcgtgattatccggaattatggcgtgtgctggatgaacttgagaggatttgtctggaggaggcactgaaagatccgttacggagaacaaagataacgctgcgtggatttggattgacgatccttgtgttcgtgcttatcggagtgtttgtcagaattatttagaacggataaaaccgttgaaaaatcgcgtttcatggtgtaagataaaaaaagcgccggacaggctgctgcccggacagatttgaagaacatttttagattgatacaagggagttaagaaaatgacacagtcgagaacacataactgtaatgagctgcgtctttccaatgcgggagagaaagtaacgctcgtcggatggtacgagaatctccgcaaggtcagcaagaacctgggatttcttattttaagagatttctatggaacgacccagattgtcgttgagacagaagagatgatggagaagctggacggagtgaacaaggagtccaccatttccgtaacaggaaccgtcagagagcgctccaataagaatacagagcttccgaccggagagattgaagtcgtgccggaagggatcgagatccttggaaagtgtatctacaatgcacttccgtttgagattaaccagtccagagaggcggatgagaacaccagattaaaatatcgctatctggatctgagaaatccgtcggtcaagagcaagatcgtgctcagaagccgcatcgtggcagagctccgcaataagatgaacgagctgggatttttagagatcacgactccgattctgacctgctcttccccggaaggcgcgagagattatctggtaccggccagaaatcatccgggcaagttctatgcactgccgcaggcaccgcagcagttcaagcagattttaatggcgtccggattcgaccgctatttccagattgcaccgtgtttccgtgatgaggacgcaagagcagaccgttctccgggagagttctatcagctcgatatggagatggcatttgcttcccaggaggatgtgttctctgttgtcgaggaggtactgccgccggtatttgaaaagtatggtgtatacaagactgcttccaaggctccgtttgtgcgtattccatatctggagtccatggacaagtacggcaccgacaagccggatctccgcattgatctggtattgcaggatgcgacggacgtcatggcagactgcggattcggtccgttcgagggacagaccgtaaaagcggttgtcgtggacggatttactgcgaccagaaaagtgatcgacggaatctgtgccgaggtggaagtgcagacagccaacaaggcttactggttcaagctggatgagaacggcgaatttgtgggaggtatttccaagttcttgcaggagcgcaaggagacagtcattgctgccctcggattaaagccgggtgactttatcggtctgaccgcaggcaagaagctggcagcgcagaagaccgcaggcgtactccgcagactgcttggcgctgcgagcgagaagcacatgaaaaaggattgctacgaattctgctggatcgtagatttcccgatgtatgagatcggcgaggagtccggagaactggagttctgtcacaacccgttttccatgccgcagggcggtatgaacgcactctgcaacgaggagccgctttccatccttgcttaccagtacgatctggtgtgcaacggcgtagagctttcctccggtgcggttcgtaaccatgacccggagatcatgatcaaggcatttgaactggttggtctcggcgaggaggatgtgaaggcaaaattccctgccatgtacaatgcattctgctacggagcaccgccacacgcaggaatcgctccgggtgttgaccgtatgattatgctgatctgcggcgaggagagcattcgtgagatcatcccgttcccgatgaataagaacgcgatggatatcatgatgggagcaccggcgactgtagatcagaagcagctggacgacgttcatatccgcattcagatgccggaagaaaaatagcgtaaaacgacagcaataaagacacaggcttttggacagactatctccaaaagcctgttttactctatataaagtagaaaacttgaatgaaaaaggagatcacagagagaatatgggaaaaagaaccggaaagaaccgtaaaacgaacggcagggcaggatacgggaagcgcgtggctgcggtgggaatgatgttcgtgatgttgttttcttttgccgcctgcgggaagacgagcacttctgaggaagcggaggcactgagcggaagctgtattgacattttaaacaaagtttacgaaacggccgatctggatgaatccatgcgggaggccatgcaggattatgagatgacgacgatcgatgcggatatggaagaatatgtgctgggcacagatgagatcacatatactgactcggcgtattctgctccgatgatgacgtcggtggcatatcagtgcgttgtgctgcgcgtgtcggacggaaccgatgtgccaaaggcaaaacagacgcttctggacaatgccaatcctgcaaaatggatctgcgtggaggcggagagtgttgcggtggagagcatcggggatgtgattttatatgtcatgggcttcgacgaggacgtgtctgcaataaaagatgcatttcttgcattggacgaatgagatggatgcaattaagaaacaataagcttttgatgtgagaaatatcagaattgactgataacactataaagagataaaaaggaacgatgagagaggaaatcctggttcgcggacagagaatgacagttctgtcttaagaccgggattttttatataaaagcaaccaatgttttgtaataaacagtatataacagttgacaacagttctatactgttatatactgtttgtcgaaggaaaacctacatactgcgcagaggtggaggagaatacaaaaaaatgaagataattgtggatcacacatcgatgcagccgatctatgagcagatcgtagagcagataaaaaaacagatcctgcagggaaccctgcgggagggagcgccacttgacagtgtgagaatgcttgcaaaagatcttaaggtgagcgctctcaccgtaaaaaaggcatatgatgcccttgaggaggagcagctgatcgcaacggtgcatggcaagggcagctttgtgctcggggtgaatccgtcactgcttgcggaagaacagaaaagagagatcgagcagcggatggaacagctggtggcgaaggcgcgggcgtatggcatgagcgacgaagaactgcgggcggttctggaattgtttttggaagcataggagtgcaatcacaggaatggagaatcatatgaatgatgggatggtgcaactgaacaaagtaacaaaggcatacgggtcgtttcaactggactgctccatggaagtgcagcccgggatggcaaccggatttgtcggggcgaacggagcgggaaaaacgacgacatttcagattctgctggggctggtgccgccggagacgggtgagataaggatcttcggaaaaccatatacagaactgactgcaaaagaccgggagcggatcggggtatcccttgcggattcgggcttcagccagttccttaccgtccgggatgtaaccgccattctgcggaatctgtataccagatttgatgaggccaggttcctggaaaaatgtcagcggtatgaacttccggcgaacaaaaaaatcaaagatttttctaccgggatgcaggcaaagctgaaattgctgattgcgatgtcacatgacgctgacctgctgattctggacgaaccgacgctgggactcgatgtgatgtccagagaggcgatgcttgaagaactgcaggaatatctggattcggagggaaccggcggagcaccgagatctgtcctgatatcctcccacatctccagcgatctggaaaagttctgcgatgatatctatatgattgaccgggggaagatcgtgcttcacggggagacggatgttcttctggattcatatggtatcttaaaagtggatgaacggcagtatcaggcgctggatcgtagatatctgcttgccggaatgcgggaagcgtatggttatcgcctgctgacgaacgagcgccggtattatcaggaaaattacccggatcttgtgatggaaaaaggcagcattgatgatattctgattttgacagcgaggggggagaagctatgaaaggattactgacgaaggattttcggattctggcagggcagaagcggtattttacgattatcattctgattgcggccattttcctttgcagcggtcagccggcgcagatcattgtgggatattgtaccatgttcggcatgctttttacagtaaacacgatctcgtatgacgaattcgatcacggctatctgtttctgttcacgcttccggtgaccagaaaagattatgtgctggaaaaatatgtatttatgctgctgtgcggcggtggtttctgggcagtttccgcagcggccggttttgtggcggattatatccgtggagatgtggtgtctcttttagaatggctgatgcccatgttccttattttattagagatgacaatttttctggcagtcatgcttccggtcagcctgaaatacggtatggaaaaaagcaggacagcaaccatgattctggggtttgcggtgcttggggctgcaattgcagcaaggaagcttctgccggagaattttgcgggagggctgaggtggtctgcgcagttaaatcctgcggccgtgactgcggtagtgtttctggtttccctggccacattggcggtatcctttgcgggcagtgtccgcattatgcaaaaaaaggtattctaaggattgccactttacaaatagtgcaaaaaataggataatggtatcacttaaaaacaacattttacaatagatgggattgatcatttatggaaatagaacatatcggtgataacaaaatccgctgtgcactgacggaacaggagatcgagagtctcggatacgatattgatgagatcattgcgaacagcgagatcacgcaggaattcatgcatactgtcttagaactcgtcgaggaacaggaacatattcagatggagggcatctctccgatggtgaaggcggagcttttgcaggatcacagtatggcgatcacttttggcgcagacaaagaggtgtcactgagggatctggtgaatacggtcagtcatatgatcagccagctggatccggacgctgcatcagggaaaacggccaaggcagaggaggggaacgcacaggccgcagcagatacggcggatacggcagccgctgcgggaacgcataagcgcaccgacccgatgatctgtgcactgcgcttttcttcctttgagaatatgcgcaggatgagcctgcttgcttttcgcgggaagattccaaagagcagtctctacaagatggacggcgcgtactatctgattctggattttacgggatttgccaaggaggagatgcgtccatttgcgttcggaacgatcgagtatgacgatgcgcactactccgatcaggggcacattgcacatatcagagagcagggaatttgtatcatgaaaaagcaggctcttgaaatgctgatgcagttgtgagaaatagataaaagccgttttgtaaataggcaaagtcctcaaatccggtcacaaaatttggtaaaaatgccgaacaacttcctgatgcattttccactatatatgctatgatggtagaggtgtgtgtacaagatatatacaccaagaagagaatagcacagaagaaggcgggggacgccggtgtgcggaaagtggagaagttatgagcagagagcagatctgggagcttgaggagaacaaacgcagcctgttaagacaggcctatcggatgaagcaggaatgtccgcatatgtcgccggttggacttgagtatgaaatgtatgccgcgattatgaaagaagtgcgggagattacggcgagattacagctgtctgcagaggcttaggatggcgttacaaaagaaaatcaatataagaataaaaaagagctttcatccgggtttgcagatgaaagcttttttgatatgataaggagaggatgcggaatgaagagacagaagatgcggacggaacagaagtctaatgtgaaaaacagtgtgggaagacttgtgtttgtaggattatccctgcttttgcaggttttgtggattttgttgctgtttttgcggttgaatgcatattctacggcaatcagtttatgctttagtgtaggagcatttcttgtggcgttaagcatttacgccaagcacgagaacgctgcgtttaaaatgccctggattattctgattctggcgtttccggtgctggggctctgcatatatctggtgtttggacacaagaatgtggtcgcaaaggcgatgcgcagacgctttgagacgattgaaccggtgctgtttgagcagattccccaggatgaggcagtgcttgggcggctggaggagcaggattttgcggtggcgaaccagtgccgctatatcaagcggtttgggcattatccggtgtaccggaataccgatgtgacattttacccggatgcggcggagggacttgcggcgcagctacacgatctcgcgtcggcagaacattttatctttatggaatatcacgcgatcgaggaagcggaggcgttcggcaggattaaggacgtgctcgccgagcgcgcggcacacggggtggaggtacgcctgttttacgatgacgtcggcagtatcggctttatcgatccgggctttatcaagcgcatggaagccatcggcgtagagtgcagggtgttcaatccggtgcttccggtcttaaacattttcatgaacaaccgcgatcacagaaagattacggtggtggatggaaagatcggctacacgggcggctacaatcttgcggatgaatattttaatatcacgcacccgtacggaacctggaaggataccggaatccgtcttgcgggagatgcggtggcaagcctgactgtgacatttcttcagatgtggaatgccacggcggaggcggaccatgagtttcagacgtattttccgaagctggattaccgcgcggcagacaccggttttgtacagccgtatgcggacggccccctgacggacggttattttgcggaggatgtttatttaaatctcatcaagagtgcgaaacactttttctatgcggcgacgccgtatctgattatcagcgatgatatgacgagggaactgtgtctggctgccgagcgcggcgttgatgtgcggattgtgacaccgggaatcccggataagaagttagtgtatcagacgacacgctcctactatgcgcctctggtgcggcgcggcgtgcgtatctatgagtacacgccgggatttatccatcagaagcagacactttgtgatggggagacggcgacggtcggaacgatcaattttgactatagaagcctgtaccatcattttgagaacggcgtgctgctgcatggctgcggggcgatcggtgccattggagaggactttgcgcagatatttgaggtgtcgcgcgaggtgacggaacagtataagggaaagcggagtatggggcttcgcatcatacagtgtattctgcggttgtttgcaccgctgttataggagaagaaaaatgcgacgcattgcgtctgcggaacggaggtttttatgctgagagagtggaaagagccggtaagacccggggaagaggaattaaagatgcgccttgcggcagccagggaaaagcttgccgcccagcagcttctcatcaaggagcagaaagtgccggtactggtgctgctggaaggctggggaacggcgggaaaaggctactgcatcggtcagatcatcgagaatattgacccgcgccattttaaggtggagtccatggagagaaagaccggggaggaagagcgcaagccgtttttataccgccattttacccggattccggaggcgggaaagtttgtgttcttagattccggctggatggatgaggtggtggaagagcgccttcacggggagctttccgaggaaaaatatgcaaagcgcatcgagagtgtgcggcgctttgaacgtcagctgacggataacggctaccttgtgatgaagtttttcctgcatatctccaagaaggagcagaccagacggatggagcgcctcacggatgaaaaggacaccgtctggcgtgtggggaaaaaggatctgtggcagaacagtcactacgagaagtgcatggatgcgttttcttcctatttgaagagcacgaatatgccgtccgcaccgtggtatattgtggatgcaaagtcgaagaagtggacggaattgcaggtgcttgagacgctgacgcagggaattgacattgcgcttgacaaccgtgatatggcggttccgcttctgcagaatgtattcccgttagagcgcatgccgcttctctcggagataccgctcgataagacgctcgatgaggagacgtaccgcaaggagttaaagcatttaaaacagcggcttggcgagctgcacaaccgcctgtaccgcaagaaggttccggtcatcatcgcctatgagggatgggatgctgccggaaagggaggcaacatcaagcggatcaccagtgcgctcgacccgaggggctatgaggtgcatccgatcgcaagcccggagccgcatgagaaggcaagacattatctgtggcgtttctggacgagactgccgaagaccggtcacattgcaatcttcgaccgttcgtggtacggacgtgtgatggtcgagcggctggagggattctgcacggaaaacgactggatgcgcgcgtacaacgagatcaatgaatttgagaaggagctgcatgactggggagccgtcatcatcaagttctgggtgcagatcgacaaggatacgcagctggagcgctttaacgagcggcagaacacgccggaaaagcagtggaagatcacggaggaggactggaggaaccgggaaaaatgggatcagtatgagacggcagtcaatgagatgatcacaaagacgagcacgacctatgcgccgtggcatatcctcgagtctgtggataagaagtacgccaggatcaaggcactccggatcgtgattgaggagctggagaaggcactcgattaggttctgttttagaatgacagaaatatgcaaattatgccatgcgtggcaatacaatttcgccctctgtcttactataatattttcagaaggaatgaaaataggaaggtaagacagggggattttttatgcagtacggacattttgacaatgagaaaagggaatatgtcattgaccgcgtcgacctgccggtatcgtggacaaattatctcggcgtgaaggatttgtgcgtcgtggtcaatcatacggcgggcggttacatgttctatcagtctccggagtatcaccgggtgacgcgttttcgcggaaatgcggtgccgatggaccggccgggacattatgtgtatctgagggatgccgaggacggagactactggagcatatcctggcagccggtgggcaaaccgcttaatcaggcaaagtatacctgcagacacggcatgagctacacgacctatgagtgcgattacaagggaatcaaggcaagccagacgctgatggttccgatggacgatgcggtggaactgtgggatgtgcgtcttaagaacaccacagacaaagagagaagattatcggtattttcgtattgtgagttctcgttccatcacattatgattgacaaccagaatttccagatgagcctctactgtgcaggatcatcctacgatgaaaatatcatcgagtatgatctgttctatgaggaattcggctatcagtatttcgcgtcgaatgtgacgccggacggatttgactgtctgcgtgacagctttctgggagcataccggacggaagacaacccgattgcggtggagtgcggaacatgcagcggttctcacgagcttggaaacaaccactgcggaagcttacagaaggatcttgtgctggcgccgggagaggaagtacggctgatcttcatgctcggagagggcagccgcgaagcgggaaaaaagatccgggaaaaatattctgacatggcaaatgtggatgcggcgtatgcacagttaagggagtattgggaaaacaaatttgcacagctgcagatcaggacgccgaatgagggaatgaatacgctcatcaatacctggaacctctatcaggcggaagtaaatatcatgttttcgcgttttgcatcgtttatcgaggtaggtggccgcacgggtctgggataccgggatacggcgcaggatgcaatgacgataccgcactccaatccggagaaatgcagacagcgcatcgtggaactgctgcgcggactcacaaccaaaggctacggactgcatctgttctcgccggaatggtttgacccggatgcaaaaaaggaaaagaaaaagccgtttaagtctccgacggtcatcccgacagtgaacgcgaaggacattgtgcacgggctggaggatgcctgctcggatgatgcgctctggctggtgccatccattatcgaatatatcaaggagacgggagagactggatttgcagatgagaccgtgacctatgccgacggaggcgagggaacggtatatgaacatatgaagcggattttggatttttccgcggaacaggtcggcgcaaccggaatctgcaagggactccgcgcagactggaacgattgtctgaacttaggcggcggagagagcgcaatggtgtccttcctgcattactgggcgatctgccacttcctgcagctggcagaatatctcggacgcacggaggatgtggaaaaatatcaggcgatgcgcgagcgggtaggaaatgtctgtaacagggaactgtgggataaggaatggttcatccgcggtatcacaaagaacggaaagaagatcggaacatcggaggatgcggaaggaaaggtacatctggagtccaatgcatgggcagtgctttccggtgcagccgatgtggaaaaaggaaaacgtgcgatggattccgtggataagtatctgtttacgccgtatggaattctgctcaatgctccatcgtacaccgtgccggatgacgatatcggatttgtgacgcgcgtttatccgggattgaaggagaacggctccattttctcccatccgaatccgtgggcatgggctgcggagtgcgtgctgggacgcggcgaccgtgcaatgaagttctacaacgcactgtgcccgtattatcagaacaatatgattgagatccggcagtcagaaccgtattcgtactgccagtttgtggtcggaagagaccacacagcattcggacgggcacgtcatccgtttatgaccggaagcggcggctgggcttatttttccgcaaccagatatatgcttggcatccggccggattttgaacacctgaccattgatccgtgtatcccggcagactggaaggaattttccgccgtcagacgctggcgcggggcagagtatgatattcacgtggaaaacccggacggcgtgatgaagggcgtgcaggaattgtatctggacggagagaaggtcgaacgtatcccagtgatggcacagggaagcagacatgacgtcagagttgtgatgggatagcacaggaaaagaaaggggacattgatatgatcaaatttggaaccggcggctggagagccgtgattggagacgattttacaaaggcaaatatacagcttctggcgcaggggctggtcaacaaaatgaagagcgagggtgtgaccgagcagggcatcgttatgggatatgaccgcagattcctctccaaagaagccatgcagtgggcggcagaggtatttgcagcggcacagatcaaggcatacctgatcaacaaatcctcgccgacaccgcttgtcatgttctacgtgatgaagcatgattttccgtacggaatgatgattaccgcaagccataacccggcaatctataacggaatcaaggtgtttactgcgggcggccgtgatgccgacgagatccagacgaaggatctggaggactacattgccgacatcgcatcggacggcgtctgcgcggttgcatatgaggatggaaaagcggcgggctatatcgaggagatctatccgctcaatgagtacatagacaatatcattgcatcggtggatatgaaagctatccgcgacgctgatcttaaggtggcactggatccgatgtacggcgtgagtgagacatcgttaaagacgattcttttaactgcccgctgcgaggtggcgacaattcatgacagacatgatacactgttcggcggaaaacttccggcgccttccgctgcaacgctccactcactgcagaattatgtggtggaaaaacagtgtgacatcggtatcgctacagacggagatgcggaccgtatcggcgtgatcgacgacaagggcaatttcctgcatccgaacgatattctggtgctgctgtattactatcttgtaaagtttaagggctggcatggacctgtggtgcgcaatatagcgaccacccatatgctggataaagtggcagagcagttcggagaaaaatgctatgaagtgccggttggttttaagtatgtctccgctaagatgcaggagacaggagccatcatcggaggcgagtcttccggcggtctgaccgtacacgggcacatcaacggaaaagacggcatctatgcggcggcgcttctgatcgagatgctggcagtgaccgggaaaaagctttcgcagatcatggatgatattcacgcagaatgtggggagatccatatggaagagcgtgattataagttcacactggagaaaaagcttaagatgcaggaagttttaatggagcagaagcagctgccggatttgccggaagagattgaccatgtctcctatctggatggcagcaaggtctacttcaaaaatggaggctgggtcatcgcccgcttctcaggcacggagccgctgctgcgcattttctgcgagatgccggatgccgtcgaggcggcggacatctgcaccagatacgagcagttccttgatctgtagagtagaaaaacgccgcatttcacattccattccgtgtcttgccacgctttgacaatccaccgggggaatgtccgacaagcacagacaatgagcggactttctagtgcctctaatcgaattgcttcacagacaatataaaaccgcgcgaaccgaaactcgttgccatctgctattgaaaacatggcagatggcaattcagacatcggcttcgcgcggttatgttttgttcagcaattcgataagaggcacacgaaagtcctaaaattgtctgcagcttgcggacatctccggtggagtgctcaaagcttggaaagacacggtataactagtccgcgcggcggtgttctgctataatggagagagaaaacggggaggcagccgtgtgaaaatacattttttcgcatgcaggaatggagatttttatggagaaaaagagacgactgtcgtcattgaagaagaaaattatagtatttgtcatcctgtgctggggtgtcccgatcgcggtattttttgcatataccaccagctcctaccggaagggaatcattgagaagacggaaggtctgatggaggatcagttagagaatatggcttcctttgcatcgatccgcatcgaggatgccatcacgctctgccagagaccttcctatgagaagacctgggagaatgcctggaaaaaatacctccggggagactattccagaaacgactatcttcaggatgtctataccagtctgcgcggaaagttctatctggacgagcgttttaatatgtatgcctactactgttacggaaccgaagatccggagagcttttcttcgcgcaccggcatctcgttaaagagttatgtggatgagatacagccttacctcaaagatgtgatagattcggattcggcgtatgcctgcgtgcgggtggtcgacgggcgtatttttatcgtccgcaatctgtacacgacgatggattatacacggtacggtacgctggtggtggagttaaaccgcagcaaggtgtttcaggatgtggataccggtcttttgaatgatatggtggtctgcttcggaagccgcgatgcgcgggttgactttgtgaaaaacgaggagaagagtgacaaggaacagcttttagagcagcttctgcaaaagtatgacggggtgagcagccacacattctcaaaggcggaggacgctacctaccgcgcgtatctgtatcaggagcggcgggatgattttcacatcggcattgtactttttgccagaaagagcgaactctattccgggctgtaccagttctatacgattgttgcgctgatgtttttgctgttgattccgctgtttggctatgtggtgtattttatccgcaggaatatccagcacccgatcgaccggatgctccgcgcttccggacggatggaagcgggagagatgggaatcacggtcgagggagacatgcccaatcaggaatttatgcagatgaaggagagcttcgacagcatgtccgcgcaggtgaagtatctgtttgattccatgtacagtgaaaagcttgcgcgcaaggatgcacagattcaggcgcttcaggcgcagatcaatccgcatttcctgaacaatacgttagagatgatgaactggcaggcacggatgtcgggagatacggtcgtgtctaaaatgattgaatcgctgggaaccgtgcttgattaccggatgaaccgcgccaatgtaaaggagattcaccttgcggaggaactgcagtgcattgatgcctatttttacattatgtccatgcggttcgggcagagactctcgatcgagcgcaagattgacgatgatctgctctatctgatggtgccgccgctgatcttacagccgattgtggaaaatgcgattgtgcatggggtggagacggtaaaaaacggcgtcatccggcttcacgtataccacgatgatgaaaatgtctacttaaaagtgcgcaatacgggcaaaaagatgacggaggaggagctggagcggatccatgctatattggagggcgatgagagcaagcttccgaagaataccggacgccacacctccattgggattcagaacgtgaatcgcagaatccgcctggtatatggggacgaatacggtctgtcgatcgagcaggaggaagactgcatcacggtttcgacgattacgataccgtacgttgaccatgaggatgaaatatcgttaaaagagagaagcgaagcgcaaaatgagttaaagaacatagcaagattgaacaaataatgtcaaatgggtctaatgccttttgtgagttctgctcgtataatatcagtatagcaaatgaaaaacatttgcaggaacaaaaacaaggagggttttgactatgaagaaaaaggtattatccatgatgctggctggcgcaatgacagtgtccatgctggcaggatgcggggcagggtccgatgagactgcaacgacagacaacacggcagccgacacaaagacagagacagccggaacaacagaagcaggcgggggtactgcagaagcatccggaaatccggtgacattaagaactgtgtcgatgttcggaggaaccgatccgaataaggagacctacgaagcaatcaacaaagagtttatggagcagtatgactacataacgatcgaagacaattcacagacatccgatgaggaatggaaagcagcagtcaatgcggacttctccgtaggcaatgagccggatgtcatccagttcttcacggatgcaaccgcagacagcatcattgcaacggataagctggtatcaattgaagacatccgcgcagaatatccggactatgcggcagacacactggattccgcattacaggcagcagcaaacaccgacggtgttgagcgtgcggttccgacaaccggatactgggaaggcttatactgcaacaaggatctgttcgaccagtacgatctggaacttccgacagactgggcttccatggagacagcgattgagacgttcaaggagaacgacatcattccgattgcctgctcgttaaacaacgtaccgcattactggattgagttcctgatgttatatgcatccggcgtggatgagtatacttccattccgacgagcgcgccggaaggatgggtaaagggtcttgagatgtttaagacattaagagatatgggggcattcccggaggataccgacaccgttgatgacgcatacacaggccagttattccgcgacaagaaagctgccatgcagttagacggttcctggtatgcaggaaacatcgaggataccgacaacaccgttgtgatcgcattcccgggtgttccggatcagaaagcagaggcgggctctttggtaggcggtatctcttccggattctatatcacaaagaaggcatgggaagatccggacaagagagatgcagcagtgaaattcgtcatggcacacacctgccaggcaggcgttcagagatactgggaagcaaccggcgctgtgtcccaggcagctgttgaggtaacaccggtagagggtgcaacaccgtttgcacagtctatcgcagagtacacaagcaacgcaacggcgatcgtggcaccgacagattccagaatcggcgatgcatacaagacacttgtggtagagattgtcaaggtatctacaggtgctatgtcggcggaagatgccatcaacgaggcactcacattggtgcagcagtaaaatcagatacagaaaacagtatgacggaggggctatgcccagcggccccttcgttttttgcacccaaaaaacagttatttttatgatagaaaggtggaagaaagatgttatataagaaaaaatggccgcttgtggtgtttttggtaccgggtttattgttcatgttagtctttctttacataccgttcgtgcagaatattaagaacagcttttatgatatgacggcaatcatcgagatgccgggaactgaatggaagtttattggatttgaaaattacaagaaattgtttacagacccggatgtgaggacggcactcgtcaattccctgaagatgatggtgctcacggtgatttttgaggtcggaatcgcatttgtgcttgcggtaatggtttcacagataaaaaagcttcagcagttattccgtacggtgtacttttttccggtagtgatttctgcaacggcgattggtctgttgttcaaattattctacaactataacggtggtatgctgaatcagattttagagagcattggagcaaagccggtcaactggctttcccccagcctggcatttatcatggtctgtatcccgacgctgtggagttacatcggtttttactttgtcattctactcacggggttaagcgatattcctgacgacatatatgaagcggcgtccatcgatggatgcagccgctttaaacaggtattttatattacactgccaatgatgaaaccggtattctttacatcggtcacactggcggtaacgggagcattaaaagtatttgatcttccgtgggtcatggtgccaaacggcgcgccgcagggactgacccatttccttggaacgtatatgtaccagcagaccttcggactgaacaattatgattatggttctacactggcggtactgatcgtggtgctcggcattgtggtgtcgaaggcagtcggctttcttacggcagatgcggacgacaaagaagcgaaaaagcgcgcaagagcagagaaaaagaagggggtggcttaaatggatgcagcagtaagtgtaacgacagtcagaaaaaaacacaggagaatcggagccggtacggttgtcatttatctcgtactgatcttctgggcggtgctcaccattttcccgtttgtgtgggtggtgctgaattcctttaaaccgtccgcggaggtgctccgctcctccttctcacttccggagacgttcacctggatgaattatcagacggcatttgagcggttaaacgtcttaagagcctataggtacagcttcgtgatctccggcacggtaacggtaggcgttatggtattcgcgtcgctgatggcattcggacttaccagatatcatttcaaaggcaaggagctgatccgcagcctcatcgtggcaagtctgatgtttccggtattttccacgatcattccggtgtttaagatgatggtggaatgggggcttctgaacaaaagcattgcggttatcctgccgcagattgctggaaacttaagctttgcgacgatcgttatgaccggtttcatgcagagcatcccgctggagatggaggaagctgcctacatggaaggcgcagatgtatttaaggtatttggaaaaattattgttccgctttgcagaccgtcacttgcaacggttgccatctttagtttcctctggtcttataacgacctctttgtacagaaaatcatgatgcgtgacccgaccaggtatccgatctccacactgttagaacagatcagttcccagtatggaaccgatttcggattgatggcggcgtcggttacgatcattgtcatcccggtcatgattgtgtatgtgctgttacagaaaaatatcatcaaaggattgacagcaggtgccgtgaaaggctagacttcttggaaagagagcggaatttgctcaagtggaggattggctatgtacaaggtgatgattgtggatgacgaaccgatcatcgtggaagggttatcgaggagcatcgcgtgggaaaagtggaattgtaaggtcgcggcaacggcgcacgacggactggaagggaaaaagattatcgaggagattcacccggatattgtgtttatggatatctgcatgccggagatggacggactggcgatgatcgctgcgatccactcgcagttcccggatctcgaggtctgtgttctgacgggctaccgtgatttcgagtacgcgaaggaggcaatccgtctcggggtgacgcgctttctgctcaagccgtccaacatggacgaactggaagaagccatcggcaagatgtgcgggaacttaaaacggaaaggaattaccggggatgagccgaagcgtgatccgcaggatgaagaagcggcggaagcgcacaaggagagcgcatcaagcagctttatcgtgaagaatgcactgacttacattgaggagaattatacgaagaagctgacgctctgcgaggtggcagagaagacgtatgtgagtcagtggcacttaagcaagcttttaaaccgccacacggggcagagcttttcggatattttaaatcacgtccgtatcgagcatgcgaaagaactgctaaaagatccgtcgctgcgcatcggagatatctccgagcaggtgggatttttagatctggcacatttttcgagggtatttaagaagcaggagggagtctctgccaatgaataccggaatcaggtactgggaaagtaaggtgccggacggctagagtacatagtatccgagcacaccgcacagaatccctgcaagagcgcctgcgatgacgtcgcgcggctcatgaacgccgccgatcacgcgcaggacggcaaggacaacccctaggagtccgagcagaatgccggcggaggggtggacatagaaaatggtggcggcaatgataaatacggaaaagacatgacggctgggaaaagatttcccggccgtatctttttctatggcaggcggaaggccgaacttctcataaggtcttggggcgttaaagatccgtcggaagagcgtgactgcggcaaaggagacggcgggaacgagaagcgcccgcaggaaaaaagcgctgccctcaagaaaaagcagcagcagaaacgccgggtacagcacaaaaataaagccggtcaaggtgtggttgagcaggcataccagccggatgcgccgcggatgtccccgtaagatgccggtgattttctcataggattctctggtcatgagacctccgatccggcaacggcgagcagtgccccgatgaaaatgcagaagtcagagatgttgaagacgatcgcgcgcagccatttcggaccgaaattcagatgaaaatagtcgacgacatgccccttcgtgtagcggtcgtaaaggttgtttaaaccgccgccgagcaggagtgcaacgcccgttttttccagcgcgtgtccgctaaggcgcatcagaaaataggaaaaaatcccgacaacgacaagaatgacggtgtggatgatgcgcagaagatttggcctttttaccatgaaattcaaagccgcgcctttgttataatatttttccaggacaatcctgcccccaagccgcggatggcgcaccttgcgggcatattttttgtccatgtaacgctttaagatgagatccgacaggaataccccgccggcaataatcgcataaaccatgtaaaaatctcctgacaggtattgatgtatgtatcatatcatcttccatggaaaatgaaaagtgatttgcgcttgcctttttttatccctgtttgtgcagttgcctgcaaacccttgaaagggcgttgcctggctgataaagtcaagacagaggcagaaaaatctgcagtaaataacgggcgggagacgggaaggcgtctcctgcctcatgagagaaaggaaaaagggattacgatgaacattatcagagcaaaagactatcaggacatgagcagaaaggcggcaaatatcatttcggcgcagattattatgaaaccggactgtgtactcggtcttgccacgggatcgacgccggtgggaacataccgccagctgatcgagtggtatgagaagggagatcttgacttttccagagtgtcaacggtcaatctggacgaatatcgcggcctggcacacacggatccgcagagttattactattttatgcaggagaacctgtttgaccatgtgaatatcgataagacggcaacgcatgtcccggatggcacaaacccggacgcggcagatgcctgcgcgaagcatgagcagatcataaagtcgctcggcggaatcgatttacagcttttggggctggggaataacggacatatcggatttaatgagccgggtgcagcgttcgagaaggagacacatctggtggatctggcagagagtaccattcgggctaatgcacgtttttttacctctattgacgaagtgcccaagcaggcatatactatgggaataagaacgatcatgcaggcaaaaaagattctggtggttgtctcgggagagagcaaagcagatatcgtctcacgcgcgttcttcggaccggtgacgccggaagtgccggcatccatcctgcagatgcatccggatgtgacggttgtctgcgatgaggcagcgctttccatgtcaccattatagaggtaaagtcagagggaaatgggggatttaagatgagaattaagaatgcacttgtatacacggtagagcacggatttgtggagcgggatgtccggataaaaaacggctgttttgcggggagtgaagcggccggcacggacggggaagagattctggacgcagggggagattacctgattccggggcttgtggatatccattttcacggatgtgcaggtcatgatttctcggacggaacaccggaggcattgcaggcgatcggtgcgtacgagcttcgccagggtgtgacaagcatctgcccggcatcgatgacactctcggaggagacgcttaagacggtgtgtgccaatgcgtatgcgtatacaaagagaccggaggcagagcaggacaccggggcgagactgatcgggattcatctggaaggaccgtttatttccatggagaaaaagggtgcgcagaatccggcttatatccggaatccggatgtagagatgttcctgcggctgcaggaggcagcacacgggctggtgcgtctgattacgattgcaccggagacggacggtgccaaggagttcatccgccggctggcggatcaggtacatatctcggtcggacatacctgcagtgattacgagactgcataccgcgcattttcacagggggcggatcatgtgacgcattttttcaatgcaatgccgccgttcacccatcgcgcgccgggcgtgtttggcgcggcgtttgacgcgaagcatgtcatgccggagctgatctgcgacgggattcatattgatgcttcggcggtccgcgtggtattttccctgttcggggcggagcgtatgatcttaatcagcgacagcatgatggcgaccggtatggaggacggtgcgtattccctcggcggacttccggttactgtgcgtggcaatcttgcaaccttagaggacggaacgattgccggctcggcgacgaatctcatggactgcatgcgaaaggctgtctccatgggaatcccgttagagacagccgtgcgcgctgcaacctataatccggcgagagcgatcggtgcggcggatgtgtgcggaagcattaccgcaggccaccgcggcgactgtgtccttctctccaaggatgacctgtccacgaagaaggtcatcttcggaggaaaggtggtcgcctagcgctcgatccagtcacggacatccgggattttagagagcaccggaagcagtatcagactaagaataatgccgacaacaccctgtacgatgttaaacgggataccggtcgcagaggaagcaatgccggcggcgatagatgcctggtttaaggctccgctgccgagtgcggcaagtccggtttcgtagagaaaatagccgatgaccatgatggcttctccgacgatgccgccgattgcgagcgctgcgtagcgtccctttttcgagtgcagggtgtttttaaaacgatggaagagcagtccggcaatgccgcccgtgagcgccttgataatgaaagttgcaggagcccaggtcacgtagccggagaaaatgtctgagaacatcgagccgatgccggcagcgagcgctccgggaagtgggccaagcacgacgccgcacagcagaacgaagccatctcccggatgaatgtagccgaaggttggtgtcgggatcttgatgatcatggtcgccacgcatgtcatggcggcgagaagggcagcagttaccatttttttaatattttgatttgtcattaggaagtctccattctgtcagattcatataaaagtttgtatttcaacgttgatgcataagagtataacacaagatggattgataaaaatgtccagttgcgattaaattgaccatgccagtttgccggaatggtcttttttcttgcctgaaacacaaagcactgatacactagagacgatgagagagaagaataagggaggaattttatgaataaaaagtgcagaatcatattgtatgtgctgtcgattgtcatggtggcaggctgtattgctgccgtggcgcggacgaaagggagcacgccggaagtaaaggtgccgggcgaagagccggcagctgtggtatcgggtgaggacacggagcatgcgggggcggatagcggagcggatcgtgcgcctgccagggaggagaatgagaccgcggtggagaccacggaggcggaggagagaacggaagccgcggaagtggccgaagaagcggaagcgggcggtcaggcggaagcggatggcagtacgacgattctttttaccggggatgtcctgtttgcaaatgcgtttaaggcgggttatgatgcggacggaatcaagggcgtggttgcaccggaactgctggaggagcttcgggcagcggatattctgatggtgaataatgaattcccgttctcggatcgcggcacgccgatggcggacaaacagtttacattccggtgcagtccgggctatgtaaaggcattaaatgagatgggcgtggatgtggtatcactcgccaacaaccacacacttgattatggaagggaagcgctctcggatacgtttgcagcgttagacggtgccggaattctatatggcggcgcgggcgattccgcggagcgggcaaagcaggtgcaggtaatcgaagtccacgggaaaaaatacggatttatcgcggtatcccgggttgtcccgacggcggactggaaggtggaaaatgcagtgccgggactgtttagctgctatgacaccacggctcttgtggaggtaattaaggaagcgagggagacctgcgactatgtggcggtctatccgcactggggcgtggagtaccaggcatatccggaggcgaaccagacacagattgcgaaggcgtgtatcgacgccggggcggatgtggttgtgggatcgcacacccactgtctgcagggggtctcctatatcgacgggaagccggtattctacagtcttggcaattttatcttcgggcagagtatcgaccggtcggcgatgcttgaggtgacgatcgacgccgcggggcgggcatcctaccggttcgtgccggtgtatgcggcgggaggcgtgacatatcctgccgaaggcggacaggcggagtcggttttgaattatctggacggcatttcggaagcagctgtggcatcggatggaaccgtgacagaagattaactaaaattagtttacaatcagtttaaaaaagtttataatttaaagcaagaaagcttccttctgcgcggcagaagaatatcagtaaaaggagaagaagagatatgagttacatggagacttacaaagagtggtgcacaaacccgtattttgatgagaatacaaaggcagaacttgctgcaataggggacgatgcggcggagattgaggatcgtttttaccgtcagttagagtttggaaccggcggactgcgcggcgtgatcggagcgggaacgaaccgcatgaacatttataccgtgcgtcaggcgacacagggactggcgaactacattctctcccagaacggacaggagaagggtgttgcgatcgcccacgattccagaatcatgtccaccgaatttgcggatgaggcggcgctctgcctgaacgcaaacggcatcaaggcgtatgtgttcgacagcctgcgtccgacgccggagctttcctttgccgtgcgtgaactcggctgtatttccggaattgtgattacggcgagccataacccgagagaatacaacggctacaaggtatactgggaggacggagcacagatcacaccgccgcacgacaagaatatcctggcggaagtggcgaaggtgacatctttcgaccaggtgaagacgatgaagaaagaagatgccgttgccgcaggactttacaaggtcatcggaaaagagatcgacgatcgttacatggaggagctgaagaagcagtcgatccatccggaagtcatcaaggagatggcgaaggacattaagattgtatacacaccgctccacggaaccggtaaccttccggtgcgccgcgtgttaaaggagcttggattcgagcaggtgtacgtggtaaaagagcaggagctgccggacggtaatttcccgacggtatcctacccgaacccggagtccccgaaggcatttgaacttgcgttaaagctggcaaaagaagtcgatgcggacatcgtgctcgcgacagacccggatgcagaccgtctcggcgtgtactgcaaggacacaaagaccggcgagtatgtgacatttaccggaaatatgtccggtatgctgatcgcagagtacatcttaagagagaagacggcgatgggaaccatgccggagaacccggcgctcgtggagacgatcgtgacgacagatatggcaaaagcgatcgcggcagcctacaacgtgaagctgatcgaggtgctgaccggatttaagtatatcggagagcagatcaagttcttcgagcagcagcatacctatcactatgtattcggactggaggagagctacggctgtctggcaggaacctacgcgagagacaaggatgcgtgcgtggcggtcatgatgctttgcgaggtggcttcctggtgcaagaagcacggcaagaccctgtgggatgcaatgctggatatgtatgagaagtacggctattacagagagggattggagacgaagaccttaaagggaatcgacggtgcggcacagattcagtcgatgatgagtgagtaccgcacgaacccaccgaaggagctgggcggtcatcgggtactggcggtgcgcgattacaaggaggacaccagaaaggatcttgtgactggcgaggtgacaaagaccggactgccggcatccaacgtactttattatgaactttccgataatgcgtggtgctgtgtgcgcccgtccggaacggagccgaagatcaaatactactttggcgtaaaggggacttcccttgcagacgcggatgcaaagcttgcggcattgaaggaagatctgttgaaataagaagcgggagatggtatgggagcaattcattattacgaaaaagaacgggtttttaaactggatacaccacataccagttatctgatcggtatcgtggatgaagaaaagtttttgggacatatctattacggcgcaaagatcacggactatgacgtccgtgcgctgatgcgcaccggggaggcaccgtttgttccttcacagaacaaccgcgaccggagctcttttctggatgcgtttccgatggagtatccggggcacggcgtcggcgattacagggagagtgcgatttccgtatcggacaaaaacggcaatacggcggtgcagccgctttacagggagcataagatctatgcgggcaaaccgggacttccgggacttccggccacgttcggcagcgaagaagagtgtgagacgcttgagattgtgctggcggatgaagtgctggatcttacggtcacattgtactacacggcattttatgacgtggatgtcattacgcggagcgtgcgcgtgacgaaccatgccaaagaaccggtgtatcttacgaaggtattttctacggcgttggatcttgacgcggaggattaccggatgctgacgctgcatggttcctgggcgagagagcgacagatcgaataccgccagatcggctacggaaaacagtctgttggctcctgccgcggtgaatcttcccatcaggagcacccgttcgtggcgctggtgtccgcaaacgccggacaggagcaggggcgcgtgtacggattccattttgtgtattccggcaatttcctggcgcaggtggagaagaaccagtttgattccctgcgcgtggtgctgggaattcatccgcaggattttaagtgggaattaaagcagggggagacatttacggcaccggaggttgtgctgacctattcggatgccgggcttggcaggatgacgagaacgctgcatgatctctaccggaagcatctgatccgcagcccgtataaggacagggagcgcccggtgctcatcaacaactgggaggcaacctactttgactttgacacggagaagctgcttgcgattgcgagagaggcgaagaaatccggaatcgagatgctggtcatggacgacggatggttcggccaccgcaacgatgacaacacaagtctcggcgactggcaggtaaacgagcagaagattacgggtggattaaaacggctggtcgatcaggtgaatgagatcggattaaagttcggcatctggtttgagccggagatgatctcgccggattcggagctgtaccggacgcatccggactgggcgattgcccttccggggagaatgccgtgccggtcgagaaatcagtatgtgctcgatctctccagaaaagaagtgcgggattatgcgtatgagtgtgtggcatccattttgcgcagcgcgaacatcgcttatgtcaagtgggatatgaaccggcagctgaccgatctgggaagcggtgtgcttccggtggaaaagcagggagaattgctgcatcgctatgtactgggcgtctatgaattacaggagcgtctgatcaccgaatttccgcagctgcttctcgagaactgctccggcggtggggcgagatttgacccgggaatgttgtattacagtccgcagatctggtgctccgacgacacggatgccatagagcgcttaaagattcaggagggaacggcgctgctgtatccgctctctgcgatcggcgcgcatgtgtccgactgcccgaaccacacggtgggacgcgtgactccgtttgagaccagaggaaatgtggcgctggcgggtacgttcggctacgagctggatgtgacaaagcttccggaggaagaccgggcgaaaattccggggcaggtggcgctgtaccacaaatatcatgcgctgatacgaagcggcgactattaccggatcgcttcctattcgcagaatgattcgtttgactgttatgaggtggtggcaaaggatcagtcggaggcgctgatcacctttgttcaggtgcttggcagaccgaatgtgcacagcagacggatccggataccgggacttgatgagaagaaaaaatatcgtgttgagacaacgggggaagtgtactgcggagataccctcctgcatgcgggactgaatgttccggcgatgtggggagatttccagtcggcactgatacacttatccgaggtgcctgatgaacagtagttggaggatgaaaaaatggcaaaagcggtaaagctggcagatattgcgggacagcttggcgtgagtacggttaccgtatcgaaggcgctgtccggacagaaaggcgtcagcgaggaactgcgggagaagataaaaacgcttgccgatgagatgggatacaaacagccgtccgccaggcggcgcgaacacgcggtaaaaagctataatatcggtgtgctgattgccgagcactggctggataagtatgattccttctatctgcagatgtatcagcaggtggcgacgcgcgcggtggcgaaggaatgttttacgctgatggaagtggtcagcgcacagatggagactgcctgcgagatgccgaagcttgtgcaggagcagaaggcggacggtctgattatcatcggacgcctgacgggagaatatctgaagtttttgaatgaaaaagcaaaaattccgcttctgtatatggatttctgtgacgagaagacagatacggatgcggtgatttcggacagctattacggtgcttaccgcatgacgaattatctgttcgacatgggacacagggagattgcctatgtgggaaccctgcttgcaacgggatccatcacggaccgctatctggggtatacgaaatccctgatggagcacggcgttgcggtgaggggggactggacgatcgcagaccgcgacatccatacgggcaagattgatatggaccggctgttgcagctgccaaaggagatgccgacggcttttgtgtgtaactgtgatctgacggcgagttttctgatccgcaggctgcatgagcacggataccgtgtgccggaggatatatcggttgtgggatatgacaattatcttttcccgggactctgtgatgtggcgatcaccacttatgaggtggatatgaaggagatggcgagacagacggttcacacgctgatcaagaaaatggcaggcgaaccgtaccgccagggaatctgtatcgtcgagggacatatggtcacaaaggacagcgtaaaagccagaaaaaatatgggttagtgcagggaagactgccggaattgcagaggtgtgattccggcatcttttttgaacagattgataaaatgtgtcgtgttttcaatccctacggcggcgctgacctcacggatggtgagggttgtcgtgcgcagcagcgtgcgtgcggctttcagccggacccggttcagatactggattggcggaacaccgatgcagtctgaaaaatcatggcagagccggtagcggctgactccgagagaactctcgagcgcggcgagagagtgggaatgtgcgtaatcggtgtcgaaaatctctttcatgtgtgccacatgcgcgggaagggaaggcgtcgatgcagcacggcgggaagcggcgagggaggacaggacaagcgagagcatggcggtcagatgaagcgaggaaactggttcatcggagagcagctcgcgggagaggtagggcagaatacgccatacgatgtcatccgcctcggtccggttcgtatgaaaaatgcggtcgtccgcacacaaaaacggaagatattccgaaaaatactctgtggacagataaaaacagtggtagcagaaaggggtatgcgtcgtggaaaaccggtatgcggtctgatccggaagaagcatgagatcccccggtgcaagctggcaggattccggctcctgcacagcgtcgccggcagtcgttaaagtgccgcttccggattcgacatagagaaagaggaggtacggcagcgcatcccgcgtcagacggacgggggacgcgtagctgatgcgccctcctgcagggacaaaacggttgtgtacagccgatgtgtcctcgcggaaaacgaaagccgggtcgtctgaaagatcggaaaaacgaatgccgtttccggctgccccggagaagtgataagcctgattcaggcgtgccttgatcgtgatgggttccataagaatcggtcctttctgcataactatcctatattatagcggaactattttgcaatacaataggtttcttgattattaggttaaaaaatagcaaaaattaagtaattaaaattaaattaagaggaaaaagagagaaaaagaagaggctaaaatatgaaaaatgactaaaaacaggatataaaatttgtataacatgtggaaaatgcaggaaaacgcaagaaaataatatattatgcaataatatgtgatgactaaaaatagaaaaaatatataattaaattaagctacaaaatgagctataaaaaaggaggatttttattatgaagttgaaaaaagttctggcagtcagcctggcagcagcaatgactttgagcatggcagcatgcggcggcagttcatctgacagcagcgcagcatctgatgatgcgacaacaggaagtgtggcagcaaccacaactgagagtggggatgcagcagagaccacagatggtgctctgaattatgcaagcatcaaattgggcgaggattacaccgatatcacgacaaccatccatgtattcaaccagagaaccgatatgtccgaggacagctatccgggaaagaactgggaagcttacattgctgatttcaatgagatgtacccgaatatcaccgtagaggttgagacggataccaattattccgacgattccctgcttcgtttacagagcggtgactggggcgacatcatgatgatcccggcagttgacaaggcagacttaagtgagtatttcctgccgtacggtacactcgatgagatggaaggacagatcaagttcgcaaatacctgggattacgacggactggtatacggtgttccttctaccggcaatgcacagggtattgtatacaacaagagagtcttcacagaggccggcgttgcagagacaccgaagacaccggatgagttcatcgcggcactgcaggcaatcaaggattacgattcttccatcattccgctctacacgaactatgcagacggatggccgatggagcagtgggacggacagatcgcaggtacgacaaccggtgattctacctatatgaaccagaagcttcttcacacaaaggatccgttccaggattacggcgataacacacatccgtatgcactgtacaaggtactctacgatgcagtggcagacggactgacagaggatgacttcaccacaacgtcctgggaagattccaagggcatgatcaacagaggcgagatcgcgaccatggtacttggctcctgggcatattcccagatggtagacgctgattctcatggcgaggatatcggctacatgccattcccgatcacgatcgacggcaagcagtatgcttccgcaggcgctgactacagcttcggtatcaatgcggcatcggatgcagatcatcaggcagcagcaatggtattcgtaaaatggatgacagaagagtccggttttgcatacaacgagggcggtatcccgatcgctgcagacgataacgattatccggatgcatacgcagagttcggtgatgtgacatttgtatccgacgagtccgcattagagggcgaggaagatttactcaatgcattgaacgctgattccggattgaacatcaatgcaggcggaaaagagaaggttcaggagatcattgagcatgcttctaacggtgatatgtcctacgatgacatcatggctgagtggaatgagaagtggacacaggcacaggaagacaatggcgtgacggcagaataaataagacatcatgcacagacgggaccggaatgagagatctgtttccggtcccgttattttaaaaacagggtgaaaaagatggaggttggatatggcggcgacatcagtaaagaaagtagaaaataaaacagccaggcgtggattcctgaagtgggcaaaaagcaggaaggggcagcagacactgattatactggcatttaccataattccgcttgtgctgttggcagcatttacctatgtgccatttgctgaaatggtgaagttcagtttttacaaaatgaaatattccacgccggtagataaacgggtatttgtgggttggaagaattatatcgaggtattccgcaacaaggatatttttgcatccctgtggttaagcctctactacatggtaggttcggtggtacagcttgcgcttgcgctgttccttgcaacgattttgagctttaagacaaggggaggcaatctctttaagggactgatgtttttcccgtatctgatcagcggtattgcgatcggatttatctttaaatatttttacacaagaggatttgtattcgattccatcctcggatggtttggatttgaactggatagtcttccgtactggctgcgcgatcagaagatcaacaactggtcactggttgcaacttctgtctggagatatttcggcaacaacatggtgctttttatcggagcgattatgtctgtagattccgagatgtacgaggcggcggagctggacggtgcaaataaatttcagcagtttgtacatatcatactgccgagcatcaagacgattgtgacgctgaatgtgattttatccatcacaggagcactgagcgcattcgagcagccgttcgtaattaccggaggttccaacggaacggcaacgtattttatcaacatgaacaatattgcacataccagccagaaggtcggactcgcgtcggcgatggcggttgtgttacttcttatcattttcgcatgtacgatcttacagaaactgttctttaaatatgtataccgcaatgcggatcaggacgatgaagtcatgaccagggaagagagaaagcggttgaaacagtttcacaaagaacagagagcggcgaaaaaagcagcaaagggggcgatgtaaatgaaaaagcgcagaaaacagtattcggcaggagccattatctggatcatttttaaatatgtatcgcttgtgtttttttcctttgtcgccgtgattcccattatttcctgcgtcatcactgcattcaagacggaggaagagtataagacgacgaatgttatgacactgccgcagaactggttcaattttgacaactttgtggaagcgttccagcgtgcgaacatgggaagggcattcgtgaattccgtgatcgttatggtctgtgtcctgatcggagccatcatcatcggtacacagcttgcgtatgtgttaaaccgtttccagttcccgggcaacgggctgatccgcaacctgtttttattcgcggcactgcttccgggtgttgccatgcaggtaacggtctaccagatcatgcatgatcttggctttatcaatcatctgtacggctacatcatcatgatgatgggaacggatgtcatctccatctacatctttatccagtacatggaaaatattccggtgtcgctggatgagtcggcaatcatcgacggagcgtcctactggaagatctactggaagatcatgcttccgctgctaaagccggcaattgtgaccgcctgcatcttaaagggcgtgggcgtgtacaacgaatactattcggcaaacctgtatctgaccaaggaaaacttaaagacgatggcgatctccctctatacctttaccggaccgcttggaagccagtacaacctgatctgtgcaggtgttatcatttccctgctgccggcactcatcgtgtttatcgtattccagaagcagatctacagcggcattacggcaggcgcagtcaagggctgattacaggaaaagaggaacagcgatggaaacattagaaagcatgcgaggagaagttaaaacggaacttctcacacatatcattcccttctggcgtgcactgcgtgacgacacttacggcggctattacggctggctgtcttatgatcttgcactggatcagaaagcggaaaaaggatgcattttaaacagccgcatcacatggtttttctccaatgcctacacggcatatcgaaagggactttttacggaggaagactgtagaagcgcaggctataccggagaggcgctcttggaggaagcaaaacacggctacgtctttttgaaagagcactgcatcgaccgggagtacggcggcatctactggtcattaaactatgacgggacaccgcttgatacgacaaagcacacctacaaccaggcgttttgcatctatgcattgtcctcctactatgaggcgtcgcacgacgaggaagcgcttgcactggcgaagcagctcttttccctgatcgaagagaagtgtacggatgaggtcggatacctggaggcttttaccagagagttccagccggaatccaacgagaagctgtcggagaacggcgtgcttgcagataagacgatgaacaccctgcttcatgtttttgaggcgtacacggagctgtaccgtgtgtcgcgggatgagaccgtgggggagcgcctccgttggatcatggatgtgtttgcagagaaagtatacaatccggcgaagcggagacaggaagtatttttcgatgccgggtatcacacgattttagatctgcattcctacgggcatgacattgagacagcgtggcttttggaccgcggcgtcaaggtgctgggcgatgaggcgtatgaggcgaaaattgttccgatcacacaggcgcttgcggcacatatttatgagacggcgtttgacggacactccctggcaaatgagtgtgacaggggcgtagtcaatacacaccgtgtatggtgggtgcaggcggagacagtagtcggatttttaaatgcctgtgaacagatgccggatcattcggagtaccgggatgcggcgttggcggagtggcagttcatcaaagaacatgtcattgatcctcgcaggggaagcgagtggtactgggaagtgtatgaggacggaagcccgattttagaccggccgatcgtggaaccgtggaaatgtccgtatcacaacgggcgcatgtgtatagaggtactgggacgcatcaaggaaaattgaggagaattggttatgctgcataagagatattatatagaaaaagaaaagcaggaaaaactgcttgcacggaaaaacgagaagtcggatttttacaacggcgtatttgaccgttacgagtatccggttctcacgagagaacatattccgctgacctggcggtatgatttaaaccctgacaccaatccgcactttatggagcgtctcggcatcaacgccgtgatgaactccggagcgatcgagctgaacggaaaatattatctggtggcgcgcatcgagggaaatgacagaaagtctttcttcggcgtggcggagagcgacaacggaatcgacggtttccgtttctgggattacccgattcttctgccggatacctgcccggaggagacgaatgtctacgatatgcgcttgacgaagcatgaggacggttatatctacggcgtgttctgctccgagtcaaaggatacgagtgtgagcgatctctcagcggcagtggcggcagccggaatcgtccgcacgaaggatttaaagacctgggagcgcctgccgaacctcatcacgctgcgttccccgcagcagagaaacgtggtgctgcatccggaattcgtcgacggcaaatatgcgttttacacgagaccgatggatgattttatcgagacgggaagcggcggaggcatcggattcggtctctgcgaggacatcacacacgctgtgatcgatgaggaaaaaatgacgagtctgcgcaagtatcatacgatcacggaggcgaagaacggagccggtgcgacgccgatcaagacggaaaagggatggattcatatcgctcacggtgtgcgcaacacggcagcgggactgcgttatgtcatctatgcgtttgcaacggacttaaaagatccgtcgaaggtgattgccgagccgtccgggcttctgatcggaccgagaggtgaggagcgcgtcggggatgtcagcaatgtggtatttaccaacggagcggtcgtcaatgagaaaaacgaggtgtttatttactacgcatcctcggatacacggatgcatgtggcgaccacgacggtggagaagctggtggactacgtattccatacgccgtccgatccgggaagatcggtggagtgtgtggcacagcggtgcggtctcatcgagaagaatcttgcatttttaaaagcgaatgaataaatacggtcatcatagaaaaatgagccgcgtcggcggcagaaagaggtagaagttatgagcaaatataaaatgatcagccccaaagtaccgaatgtgccatggcaggagcgcccggcggagttaaacggagcaccggtatggagatacaaggagaacccgatcatcggcagaaatccggtgaagggcgtggcgagaatcttcaacagtgcggtgatgccgtacggggatgagttcatcggcgtcttccgcggagaacagacgaacggaattccgtatatctatctgggaagaagcaaggatgccatccactggaattttgaggaaaacaagattaactttgtggacgagaacggtgagtccttcatgccggtctacgcttatgatccgagacttgtgaaggtggaggatacctactatattatctggtgtcaggatttctacggcgcagcgatcggtatggcgaagacaacggattttaagacatttaccagaatcgagaatccgttcctgccgtttaaccggaatgcggtgctgttcccgcgcaagatcggcggcaatttcatgctgctctcgagaccgtccgacagcggccacacaccgttcggcgatatttttatcagtgagagtccggatctcacctactggggaaaacaccgtcatgtgatgggcaagggttccgagtggtgggagtccttaaagatcggcggcggtgcagctccgatcgagacatccgagggatggcttctgttctaccacggtgtgagcggcacctgcaacggatatgtgtactcgatcggcggtgcgatcttagacatcgacaatccttccatcgtgaagtaccgctgtgagacgtttcttctgactccggaagagtggtatgaggagcgcggattcgtgccgaacgtatgcttcccgtgtgcaacaatccacgattcggagagcggaaagattgcaatctattacggagcggcagacagctatgtgggactggcgttcacggaactggatgacatcatcgattacatcaaggaacacagtgtggtgacgacaaccgataccgagatcggaaaaagataacagagaactggaatgatggggctgcggcagccggaaagagaaggacgcattgtgtgcgtaacacctcggggctttcgcagccctgctgcgtatccggcggggagccggaaggcagagggggaaaagaaatgacagcaaaaaaaatggtcaggaatatcgagccggacgatccgatgttacagtacagcggaagaatcgatgacgacgatccgaaggcgccggtgcttatctatgcggcaagctgggtgaaaatgatttttaccggaacatcggtggcagtcacgcttgccaaccatcatgcgtactggacaaatgagatgggctatctcttagacggggtgcaggggcgcatccgccttttgaatgacggaaaaaagaaaacctatgagattgcggggcagctgccggatgcgcggcatgaactcatgctgttcaagcgtatggacgcctgccatacggtgacattctacggatttaccgtggatggcggcgcagatcttctgccgccggagccaaagcccgcccgccggatggaagtgtttggcgacagtgtctcgtgcggcgaggtgtcggaggcggtcgactatgtcggaaaagaggatccggtgcacgacggacagtattccaacagctggtattcctatgcctggatgacggcgcgaaagcttggggcagaacttcacgatacctcacagggcggcattgcgctgcttgacgggacgggatggttcggcgcaccggcgtactacggtgtggagtcctgttacgacaagctcgcatacaatcctgatctcggagaggtaaagaaatgggatttttcacgctatacgccgcaggtggtggtggttgccatcgggcagaatgacaatcatccggtggactatatggcgtcggatccggagtgcagtgcggcggagcactggcggaagcgctaccgggaattcatcgagacactgatgaagcgctatcccaaggcgcagatcattcttacgacaactatcttaaaacatcatccgaactgggatgcgtcgattgggacggtgtgtgggcagatcgcaagtgagcgcgtgcaccactttttataccggagaaacggctctggaacgcccggacacatccggattccggaagcggaggagatgtcagaggagctggcttcctatatccgttcactcggagataaaatctgggatgtgtgagagacaataaagggaaaagaaagagagaaggagcagaaacatgaatatgcagattgatctggaaaagggaattgcaaatgtgggagatgtgagcagaatgaaggaggtcatggcgcgcgccagacgcggagagcagctggtaatcggttttatcggcggctcgatcacgcagggaagcctctcctcgacaccgcagacgtgctatgcctaccgtgtgtatacatggtggaaagagacctttccgcaggcggagtttgtctactgcaatgctgggatcggcggcacgacatcggagttcggcgcggcgcgtgtggggacggatcttctggcggagagaccggactttgtaattgtggaattttccgtcaatgatgagagcacggagcattttaaggagacctatgaaggactggtgcggaaaatccttggtgctgcgtggaatccggcggttcttctggtacacaacgtgttttaccacaatggagccaacgcgcaggtgatgcacgcggcaatcggcagacattatgatctgccgtcggtcagcatgcagagctctatttacccggaggtggtggcaggacggattgaaaaccgcgcgatcacgccggatgatctgcacccgaacgatgagggacatgcgctggtggcgtcggtgattacttattttctggagcaggtacgaagcggaaaactgaccggcagcaatgccagttttgcaccgggggcaaagcttccggttccgcttacaaaaaatgcctacgaggattctgtccgcatccgcaatgccgcggcgccggatatggcaggattgcagcagcccacgctggatggatttacgcccgatgagaccgcacagaatggaatcacggactgcttccgctatggctggacggcggaaaagacgggggatgccatcacctttttggtggagggcagctgcattgccgtccagtaccggaaatcggtaaagcttccggcgccggctgcactggcggtcgtggacggcgatgaggagcatgcggtgcggctggatgcaaacttcgatgagagctggggagacaaactggaacttacgacgcttttagaacacggaaaagaggggcggcacaccgtcacgatccgcctcgcagagacgcatgaggacgatgcggttccgttttatctggtgtccgtgatcgcagcggggagaagaggaagagactgacggcaagagacagcctattttgcagaatgtgcgtgtaaaaggattgcaaaatcagaaaaaatgttggaagataaagagagacactgcgattgcaggagcaggaggttataagaatgtttcgagaggattttgtgtggggtgttgcgagcagcgcctatcaggtagagggaacggatgcggcggacggcagaggcgcgtgcgtctgggatatgtttgcggcggacggcagagtgtttgaacatcagaatgcaggcacaagctgcgatcatatgcatcattataaagaagatattgcgctgatgaagcatctggggatccgggcgtaccgtttttcactgaactgggcgcggattctgccggagggaaccgggcgcgtgaatgagaaagcgatcgccatgtaccgcgatatgattctcacgatgaaggaaaacggcatcacgccgtacctgacgctgtttcactgggaattcccgcaggcgctttatgagcggggcggctggcagaacccggacgtggtgcaatggttcggagaatatgcgaaggtggttgccgagaatttcagcgacatctgcgaatattttattacgatcaacgaaccgcagtgcgtggtcggtcttggacatctgagcggtgttcatgctccgggcgtgaagcttcccgtggcgcagacgtttctggtggcgcatcatcttctgatggcgcacgggcaggcggtcatcaacctgcgcagatatgcggtccgaccggtcaagatcggtttcgctccgaccggcggcgtggcgtatccgtacaccgaccggccggaggacattgaggcggcgaaaaaggtgtatttcggattttacaatccgatcgataactggacctggaatgtatcgtggttttccgatccggtattccttggacattaccccgaggaggggctgaaaaaatttgcgccgtatcttccggagatcacacaggaggatatggagctgatctatcagccgcttgattttatgggacagaatatatataatgggtactacgtccgcgccggcgcagacggcgagccggaatttgtagaccgtgcgccggggttcccgaagacgggatcggactggccggtgacgccggaggcgttttattacggcattaagtttttgacggagcgctatccgctgccgctctacattacggagaacggcatgtcctgccatgatctggtgagcagtgacggcagggtacatgacccgaaccgcattactttcctggattcctatatcggggcaatgcagaaggcatacgatgagggcgccaatgtagccggctatttcctctggacattcctggataattttgagtgggcggacggatataagcagcggttcggcattgtttatgtggattttgcaagccagaggcggattgtgaaggattccgctttctggtatcagaaaataatcgagacgaatggaaggatgttgacaatgaatcagacaacaaaagaaatcttatttttagatccggtgtgcacacacaatatctggggcggcacccggcttagaacggagttcggctatccggtggagggggatgacatcggcgagtgctggggcatctccgcacatccgaacggcgacggcagcatcaggaacggtgtgtacgccggcatgaaactgtcaaaagtgtgggaggagcacccggaggtatttggaaacctcgcctacgaccgcttcccacttttgacaaagatcatcgatgcgaaggcggatttgagcattcaggtacatccggatgacgcctatgcaaaggaacatgaaaacggttctttcggcaagacggagtgctggtacattatggatgcgcccgagaacgccacgctcgtgatcggtcacaatgcgaagacgaaggaggagcttgcctccatgatccacgagggacgctggagcgaatttatccgcgagattccggtgaaaaagggagattttatccagattgatccgggaaccgtccacgccatcaagggcgggcttctgatcctggagacacagcagaacagcgatattacctaccgtgtgtacgattatgacagactgcagaacggcaagccgagagagcttcacattgagaagagtatcgacgtgatcaccgttccggcgaaatccgtcgaggacagtgtaacgtctgcactcggactgccggagaaccggctgaacgagctgtacgcctgcggatactatcagatttacaagctggatgtcaacggaacatgcagttttgcacagaatcatccgttcctgctgatgtctgtgctggaaggtagcggtatcgtcaacggccagccggtgaaaaagggagatcactttattttaccgtgcggattcggcgaggtggagatgcagggagagatgagtctggtggtatccacggtgccggcgcaggcttaaggggaaaatagctctttcggttccggaaaagatttgctataatcagaccatagaaaaagagaacacctggaaagaggaagcatatgaatcaggaagagagacgtcagagaagacagaaagatacgaaaagtgcggtcattgtgtgtgtgatagtcgtgctgatcctgctcgtgttagtcgcgggcggagtatttcttgtgggacgcctgctgccaaagggaggcggacagaatgaaggtaccgacggaaccgagctgccgggagagaatgtcgcggcgacggaggaagtaacggaacagccgcagacggaagtacagaccgatccggtggaggagcaggcggcgcagcttgtgtcccagatgacgcttgaggataagatcgcgcagatgtttgtgattacgccgaatgcgctgaccggatatgcaagcggtgtgacggctgcgggggacaccacaaaggaagcttatcagagccgtccggtgggcggaattgtgtatatggcagacaacctcaccgacccggagcagacgaccaccatgctctccaatatgcaggagattgcaagggagcgcaccggacttccggtatttttatgtgtggatgaagaaggcggcagtgtcgcgcgcatcgccggcaatgatgccttcggggtgacggacgtcggcaatatgagcgatataggagcgagcggggatgtgcagaatgcatacaatgcgggaagcacgatcggcagctatcttgcggcactcggattcaatgtggatttcgcgccggtggcggatgtccttaccaacccggacaatcaggtgatcggacagcgctcgttcgggtcggacgcgcagacggtcgcgggaatggtgacgtctgaactgcagggactttccgcggcgggagtgtacggtatggtcaagcatttcccgggacacggcggcacttccggagattctcatgacggggcggtgtccacggacaagaccctggaggaactgatggcggaagaactcgtcccgttccagagtgcgattgacggcggcgtgaattttgtgatggtcggacatatctcggctccgaatgtgactggagacaatgcgccggctacgctgtcgaaggtgctgattaccgatgtgcttcgcggacagatgggatataacggaattgtcattacggacgccatgaatatggaagcgatcaccggattctacaattcggacaaggcggcggttctggcagttacagccggggcagacatgattttgatgccggcggactacaataccgcctatacaggaattctgaatgcggtgaatgacggaacgatcaccgaggagcggatcaatgaatccgtgacgcgtatcgtgaaggcaaagcttgccatggggcagccgtaaaagctgtttgtattttgcggtaattatggtacaatgaaggcaagtgttatacattaccatacgaaagcggagggatttgcgtggaagatacgaagaaaaatgagatgtgggggaaagtgatggcaccgcttgccggctttcttgccattgtgctggtggcgtttctgatcattttaaaattattggaaagcggagtgatcggaacagtcatggcgatgattctgatctgcgtgatcgtggctgccgtgttcggcggaatcttcatggtgatcaagtcgattctggatcagatccggtccgtgattaacggaaaggtatcggagaatacaaaagttgcggaaaaggcaaaaaagcttgccgaccgtgaagacggcatcggggagatggtgcgttccatcgagacgtccgtttcatcgattgagctggtgcttggaggaatccgcaaggctgtggatgagctcgaaggggtatccggtgatttccagcagattttctcggaaatgtcggagtcgatggatcagacggcagatgctgtcgatacgatcaccggcaatacggtgtcccaggcgtctgagacggcggatatgaaggaaaaggtggacgcgatcagcgtgtcgatcgatcatatttcttccaatattgaggatctgacgaagagtgcgcaggccatgcgtgaatataaccgttcggcggagcagattatgcaggagctgattgccatcagtgaggagagcggcgttgcgatcgagaatgtcagaaagcagacagatctgacgaatcagtccgcgcagcagatccggacggcgactgagatcattgcgggaatttcaagccagaccaaccttctggcccttaatgcgagcatcgaggctgccagagcaggggagcacggtaagggattcgctgtggtcgcggaggagatccggacactggcggatcagtccagagagtccacagagcagattaaccatgtcgtgaatgtcctgctggataattcaagcaacagcgttcagattaccgagcaggtatcggaggcattttccagacagaatgagaagattcatgacacggaggagatcttcaaatcattgaaccgagaaatcgaacaggtcggagatgctatcggcggaatcggcacggaggtcggcgatcttgagaatcacaagagcgtcattgagaacggggtcacttcccttacggcttcggcagatgagaatgcgaagagcgcagaggtcaccacagataatatgggacgtctccgcggcgtggtgaaggagtgcgatggcgtaaaagcgcacatcgtcagcgtatcggacgagctgattggatacatccgtaagttttcggacggttcgattctcgacaagttcggtgcgggtaaaaacagataaacatttagcaggaacacaggaagtattgttacagagagccgtattgcggctctctgtaagtggttataggggagaaggtacagatgaatcatacaacggactggggcagaagatggcgcaacaccggctatattacattctttttgagcggtatctgcgcaatatcgagcgggattattgtaagtattctgcagggaaaatatgaatttgactatggcatgacgggtacgatgctcggactgatgagcattggaaatatggcggcgtcctttgcggcgggtattctgccgcagaaaatcggagtgaagaatacagtgcttcttctctgcagcggttatttcctagggtactttctgatggcggtgactggaatgccggccgtgttgatggcggcatttctgttggtcggatttgcaaagggaggggcactcaataattgcacaatccttgtaaaagacaatagtgccgatcgcacacgcggcatgaacatactacatgcctgctatgcgagtggtgcgctgctgtgtccgtttcttgcggcgtcgcttcttgaaatcaacgacactctgccgatggtgggagtggcggtgacggggctgcttttgtggatgatatttttgacggcgggacttccgggcgcggtcaaagagaagaacggcgaacggggaaagatctcgtttgcatttttgaaggatccgaaattctggctgattaccggacttttattctgccagaatgcggcggagacgagtgtgacgggatggctcgtgacatactataaagacatgggaatcctctcgggttcctttgcggcatacacggtaacggtgatgtggggggcgactctgatcgccagacttctgatcgcgttcgtttttccggtgcatcatatttttcgcacgcttgcgtggatgggcggctgctgcagcgtgctgtactgcgggcttgtatacatgcagcatccgacgggagccatcgccatgctgttcgcctttgcattcgccatggcaggggtcaatccgatcgccgtggcgggagccggcagggagatgaatgcaacgagtctcggtgtgatgctgccggtggcagggattggcgcgatcgtgatgccgtggctgatcggtgtgattgctgatcgtgtggggcttgtgaccggaatgttctgcaatctgattccgtgcgtgggcattctggttttttccgtattgatcctgaaatatcaggcaaagaattgaacttgtttttcaaaataaaggtagaatgctaaatattgtgccatttttgccaaaaactatctaaagaaaaaagtgcggttctgtgttacgatgcagacagatgaatgttgacgatactttttatggagggatgcgacacatgagagaagtaatcaattttaatacgaaatgggcatttaccaaggaagccacagaagtgccgaaggagatgccagagaagtggtactgggtaacacttccacattcctggaatgagattgacggacaggacggcggcaacgattattaccgcggaacctgttattatgcaaaacagttaaagaagagcgaactgccggaggcagactgctattatctggagttaagaggagcaaacgcttccgcagacgtctatgtgaacggcaaggcagtggtacatcacgacggaggatattccacctggcgtgtagacatcacaaaagagctcacagaagaagagaacctgattgtgatcgctgtggagaatggcgtaaacgacagagtatatccgcagaatgcagatttcacattctacggcggactttaccgtgacgtcaatatcattgcggtaaataagtcccattttgatctggactactacggcggacctggcattaaggtgacaccggagatcaagggcgcggatgccagcgtggaggtagaggtattcctgacgaatgcagctgcagaccagaagcttgtatataccgtaaaagatgcagagggcaaagaggttgcaaagacagagaccgcagccggcgagacaaaggctgtactttccattccggcagttcatctgtggaacggaaagaaagatccgtatctgtacaccgcagaggtggctcttgtatccggagaggagaccgttgatgcggtaagcacacgtttcggatgccgtacctttgagattgatccggagagaggatttatcttaaacggagaggaatatccgctgcgcggtgtatcccgtcatcaggacagatggggaatcggtaatgcgctgcttccggagcatcacagagaggatattgacttaatctgcgagctcggtgctacaacgatccgcctggctcactaccagcacgatcagtatttttacgatctgtgcgatgagagaggtcttgtaatctgggctgagattccgtacatttcctctcacatgccgaacggacgtgagaataccatttcccagatgaaagagctggttgttcagaattacaatcacccgagtatcgtggtttgggggctttccaacgagatcacgatggcaggaagctcggatgaggatctgcttgagaaccacagaatcttaaatgacatggttcatgagatggatcacacgagactgaccacgatcgcggtggtatccatgtgtgatattcacgatccgtacatccagattccggatgtgatctcttacaaccattacttcggatggtacggcggagacgtatccatgaacggaccgtggatggacaacttccacaaagagttcccgaatatcccgcttggaatgagcgagtacggatgcgaggcgctgaactggcatacctctgatccgaagcagggcgattacaccgaggagtatcaggcatactatcatgaggagatgatcaagcagctcttcaccagaaagtatatctgggcaacgcatgtatggaacatgttcgatttcggtgcagatgcgagaaacgagggcggtgagaacggtcagaaccacaagggactggtaactttcgaccgcaagtacaagaaagattccttctatgcatacaaggcatggctgtctgatgagccgttcgtacatctgtgcggaaaacgctatgtagaccgcgtggaagataccacgaaggtaactgtatactccaatctgccggaggtagagctgtttgtcaacggcaagagtgcaggaaagcttcaggcggaggatcatttcttccactttgaggtaccgaatgtcggagaatccacactggtggctgttgccggagcgtataaggatgagagccacatccgcaaggtggataccttcaacgaggagtacagcctgaaagagagcggcgcaatcctcaactggttcgacatcacagagccggaaggatattattcactgaatgacagactttctgatatcatgaagtccgaagagggaaaagcactcttcatgggactgatgtcaaaagttgcagcgggaatgagtcagggtaatgaaaaaaatgacggaaatcctgcagcaggagcaatggcgaacccgaagatgctggaaatgctgggcggatttacggtcatccgtatgatcaacctgatgggtgcggcaggaccgaaggttgagtggaagaaagaagatcttctcggactcaacgcacagctcaataagattaagagagtagactaagatagaagcttaaaagaccggggcatggaatgtggtgggcagagatttaaaaaaatctgtacctgcacggttccggactgccaaccggcggcgggaatcctttgaagcaaattgggagcatttcttctatgccgcgtttggtatcggattccgtgtctttccacgttttgacaatccgcgaaagatgtccgacaaccgcagacaatgggcggactttttagcagcgctagcaacgcttcttcacagacaatataaaaccgcgcgaaccgaaactcgttggcatctgctattgaaaataaggcagatgccaattcaaacatcggcttcgcgcggttatgttttattcagaagcgcagacaagcgctgcacaaaagtcctaaaattgtctgcggattgcggacactctccgcggagtgttcaaagcttggaaaaacacggatcatcggagataccaaacgcggtatagattagaaataccccattttgcgtttcggattcccgccgccggttggcagtccggaacaggcagatacagtatatttgcaaaatccatgcctgccacattccatgcccggtcttttagcgtctccactcgcgtggtgtcatgcccgtgatgcggcggaagagccgtgtgaaatagtggacgtcggggatgccgcaggctgccgcaacatcctgcaccggcaggagggtactgcgtagcagcttcttggcgtattcgatacggtttgcgttgacgtagtccgtcagggtcatgccgacttcctttttgaacagcgtggacaggtagcttgtattcaaaaacagttcgctggcaaaacgtttcaggcttaagtccccggccagtgaggcgtctatggtgacgagaatctggcggatcggatcggaatacgaactcatgcttcgctgttccacgagctgacagtaactttgaaccatgtaggatatgagatcgttgatttcttccacggattggatgctctcaatcatgcgcgcaaagttgccggagacggcgtcgatataaaacgggtggacgcccgtttcgtacgcttttctccgcaacagcgtgttgagggtcagaatcaggttcttgcggttgcggagtgcgtcctccgtgcgggggacaaagcgcaggtttccgagagcctccatgaaggagagggcacgggcgctgttgccgtgagagatggcgtcgagcagctcatcctcgatatggtagcgctcttcaagaaggtgcatgcttaagaccgggtcctccggtacgacaaactggtgcttttccaaaaaggactctctggtctcgagatctttcaaatgcagggtctgtacggatacatccgcgtcggcatccagcgtctgatagacgtggcgcagcagggcggtcatggaggctttgtccgcgatcagcggcagggcgtgataatattcctgcagctgtggaaaaagttcagccggaatatccagccggtttataagcgacagaatctgggagcgctcaaattctttccagagaaaaggcccgacgaacaggaaggcacttttatccggcagacggaaaaaagaataattacactcgtaataatctacaataaaatagatggtgttctgcacaaatggaaatggcgcctgtttttgcgcatcggcttcctgcatcaggatactgttgcgcagtccgagatccagatccgccagttctaactgtttgcggtcggtcagtctgcactggatatgcaggtcagaaaaatatgcggtaagaaaagataaaatcggctgctccatcaagaacctcctgtccgggtcagtgtctgttgttttgattttggcacaatattttctgttatgcaaggaaaaacaaaaaaatgacaaggattattcatccctttaaagcatcggcttgcagaccggagcaatttatgataattctataacaacgtgttcacggtgaacacattttagaaaatagtgcagaatgcttgaaagagaggatacccatgaaaatcacagcttatgaagtgagaccggatgaaaaagattacctgcttgccgcagcacagcaggagcagatagagattacactggtgcaggggccgatgacacaggacaacattgatcgtgccgagggagcggacggcattacgattcttggagatacaaagatggacgccgcattgattgaggagactgcaaagcggcgtatccgcgtcgttgcgacacgtaccatcgggtatgaccatattgacatgaatgcggcgaagagcaatggcgttcacgtctgcaacggctactacgatccggacggcgttgccgagtatacggtcatgctgattttaatgtcgcttcgcaattataagcaggcactgttccgcgggaatgccaacgattattcgcttggcgggctgatcggaagggagcttcgtaatcttaccgtcggtatcatcggaacgggaaaaatcggacagaaggtggcacagaatctgcaggggttcggctgcaggattctggcatacagcagacgtcagaatgccgatccggcgcttggaatcgaatactgttctctggaggaactgtacgcgaagagtgatattatctcactgcacacgccactgtccaatcagacacgttatatgattgataaaaaggcgatcgaccagatgaaggacggcgtcattctgatcaactgcgcgagaggagagttgatgcgcgtggatgacatcatcgagggaatcgagacgcggaagatcggtgcgctgggactggatgtgatcgagcatgaggagggaatctaccatatggatcgccggtcggatattcttgcaaaccggaatatggcgtatctgagacagttcccgaatgtgacgatgacgcagcacattgcgttttatacagaggaagcggtaaaaagcatggcggagagcggtattgtcaatgtggtgaaatgcctgaaaaaacaggataatcctaacctgatctgctaagttcatatacaaaaagagtctgccacaagaaaacttgtgacagactctttttaaatccattgtttgcaatatcttaatctaacaaataaaacaagtctattttaagaaaaaggtacatgaaactagtgatttaacgcggtaagcttaccgcctgcagtaattattttactacagttacgttggttgcctgcggtcccttggatccttctacaacgtcgaactctacggaagcgccctcttcaagagacttgaaaccttccatgttaagtcctgagtaatgtacgaatacatcgttgcctgactcgtcagaaatgaatccgtaacccttctggttgttgaaccattttactgtacctttcatcaaaaagtacctccaaaaataatactaactgtaacttacagctattagtacaatatcataagaatttataaaagtaaagtaataaattaaagttcttcaaaactaatttcatgcgcagtgagaaagcgctttacaagggaatcccactcctgatcgaggctcttgtccacggagaaaatccggtacgaaatgcccgtggtaaggagcagttttttctgctggaatttcagattgataaacattcccgtaatgtcctccggggtaaaagaactgtgggtcgaaagcagtgtccgttccagattcttcggggagagcagaaagacaaatttaaaataagaaggagtgcgtctgcccttgatcaggtcaaaacattgcggacgtacctgttcaaacgggagaaaagaaagtcccgtcagtccgagcgcatcggcttcatctgatgaataaaaatcgggctggatcgtgccgtctaagctccaggtgacgctgcccaagatgacggcttcctttagaagaaagtgcccgaacgtgtccgtacacagcagtttattcataaaatctttaatttccggtagggaaagtgcaatcatagtcttctccgtgtcatatagtattggggcgcattgcctttgtgtagtataacacagattggggacaaatagaaagccgattgggaaggtttgcttcacaatatgatttctggtatgataggaagctgagagaacagccccggaaggggtcacagataaagaagaaaagaggacatagacatgaaagagacagaacttttatttgatttgctgaaaaaaggtgtgtcgccggtacaggcagtccgcgcctgcaaagagcgcctggagagcgcgggatttctggaactgccctatgatgagccgtggaagctgcagaaaaacggaagatattatgtaaatcatcatgacaccacactgttcgcgtttacggtggggggcggctggcaggagacaaagacgccgcagattcggatggcggcagcacatacggattttccgtgcctgcgcatcaagccgtcggcggatgtgacggcttgcggttacgcgcaggtgaatgtggaagtatacgggggcgcgatcttaaatacctggctggatcgtccgctcggtattgccggccgtgtggcagtgcgcacacaggacgcgtttgccccgaagattgtggagtttgtatcggaaaaaaatcttctgaccattccgaatctggcgatccacatgaaccgcgaggtcaacaagggtgtggagctgaaccgccagacggatatgctgccggtctttgcgctgctgccggaggaggagaaaaaagcggactacttccttacattcctggcagacgagctgtctgtggagaagactgacattctggattttgaactgaccgtatactgtaaggaaaatccggaattcatcggtctcaacgatgattttatctcaagtccgcgcctggataacctgacttcctgcgcggcgctcatctccggtctgattgatgccaggcggatggagggaatcaacctgatcgcactgtttgaccacgaggagatcggaagccgcacgaagcagggcgccggctcgattctgctgcatgacatgctgcgccgcatcttaaaagagctgggacgggaacagacggcggagcaggatctctatcgcagcatgctgctgtccgtggatgtggcgcacggcatccatccgaaccaggcaggaaaaatggatcttaccaacaagcccgtgctcggaaggggattctgtatcaaggaggcgagttcgcagtcctatgcgacagactgcgaggcgattgccatcatccagcagatctgtgagaaagagaagatcgcgtaccagaagtttgtgaaccgctcggatatgccggggggaagtacgcttggatcgatcgcttctgcgcttcttccggtgaagaccgtggatatcggaatcccgcttcttgccatgcattccgcgcgggagctgatgggcagcgctgaccagcaggcgttaaaggatcttgtgaccgcatattttacactcgcttcgtgagaaagaatgcttcgtaagatataatttagataaagtttagaaattacctctatacaaaaaatggtttttgtgttaatgtaacatagtattgaatactacatgcgatagaaacgaaaaatatattaacggtttattgataacattaaacacataccatagaacaggtggagggattgccatgtataagattgttgtggacagctgcggggaattaccggaggaactgaagaaggacggacattttgagacagtgtccttagaacttgaggtggacggttaccgcattaaggatgatgagacatttaaccagcttgattttctgcgccgggtgaagaagagcatcacgggaccgaagtccgcctgcccgtcaccggagcagtatatgcaggcgtatgagggagaagcggagcatgtatatgtggtgacgctctccgggaagctgagcggttcctacaacagtgcagaactcggcaggaacctctacgaggaggaacatccgggagagaacaagcagatctatgtatttaactccaggtctgcatcgatcggggagacgattattggtcttaaggtgcaggagttcgaggaggcaggtcttccgtttgaggaggtcgttgccagaacggaggagtacatcagctccatgaatacttattttgtcttagagacgttagagactctgcgcaagaacggaagactgaccaatctgaaagccctgattgccaatacgctcaacatcaagccggtaatgggttccacaaaggagggcatgatctgccagctcggtcaggcgcgcggaatgaacaaggcacttgagaaaatggtgcaggatatgatcgggcgcacgagggactgcgaacagcgtgtgcttgccatcgcgcactgcaactgcccggagcgcgccgcagcggtaaaagcccgcatagaaaagcttgcaaatttcaagaaaatcattatcataaatactgccggtgtcagcagtatgtatgcaaatgatggcggcgtaatcatggcagtgtaagacacgcgggtgtgtcgctgctgcccggagaggaacgcgggacacagatgacatatgaagaagtagtagatcagatcaatcagatcagaagattcgggaatcttgccggagtggaggttgccgggcgcatgttaaaggcgcttggcagtccgcaggcggggattccgttgatacacatagcagggacgaacggaaaaggttctgtctctgcttttctctgcgcaattttaagggaggcgggacttcgcgtcgggatgtttacctccccgcaccttgtggactttcgggaacgcatccagataaacggggaaatgatctctaaggaggatacgcagaggatcggcgtgcagcttcttgcgatggattttggcgtacagccgacgatgtttgacgttacacttgccatggcaatcctctattttaaggaacaacgatgcgatgtcatgatcttagagaccggacttggcgggaggctggacgcaaccaatgccgtaggtgtgccggatgtaaccgtgatcacaaagatcggctatgaccacatggcggtgcttggaaatacgcttgctgagattgctgcggaaaagacgggcatcatcaaaaaaggcacctcgcttgtgcttgagaaccaggaggcagaagtcatgacggtgtttgaggcgaaggtcagggaggaaggaattacagatttccggctgatcgaccctttggagataaaagagcagacttaccgcgacggcagacagtatttttcgtttggtgcctaccgtgatctgtccatgcgcatgcttggcgttcatcagtatgagaatgctgtcgcggcgcttctcggggcggaggcatttttcaggagacatacagagtggatctgcggcgggacaaaagagcgggaagagggcgtaaggcgcgcagtctgtcaggggatcgctaagaccgtatggaagggcaggatggaaatcctctcaaaaaaaccgttcctgttggtggacggcgcacacaacagcaacggcgtggaagcgttaagagagagcctcgtggcgcttttcccgggagaaaagtttcattttatcatgggcgtgatggcggataaggattatgagacaatgatcggggaattgctgccgcttgccattgattttacgacctgcacggtggagtgcgagcgggcgctgcaggcggacgccctggcggattgcatccggcggaaaggaattgcagctgcatcagctgatgattttgcgtcctgttttcagagagggcggctcgatgaaacacatcgcacggttgcgtttggttcgctctatttcatcggtgagatcgaggcgctgtttgaggcaaaatagttacgaaaagattacagaatagagcgtttatgacaaaaatgatacaatttcacaaactttcagtaatagttcaccattttgtaatatttcgcctataatgaggtatagtaaatagggatacagtagatagaagtcagatagaaagagtctgtggaatgttatttagcagttttgagtttttatttcggtttttgccggtttttttagtgatatattatcttacaccgaaaaagttacgcaatgtcacattgctggggggaagtattgtcttttatacaattggcgaggcgggttatattacgattctccttgcgtgcgttctggtcaattacacgctgacccgtttgatgtaccggaagaatacggacgggcggggaatcaggcagaaacgcttattgcttcttgcgctcgggtatgatctgggcgtgctgtttttcttcaagtacagtggtctggcatccggacttccgcttggaatcagtttttacacgtttcagattatggcgtacgtgattgatgtgtaccgcggaagaattccggcagaacagtcgctgcttcggctgggaacgtatctgaccatgtttccgcagctgatatcgggaccgatcacaaattatgcggatgtgcgtgtagcattgggaagagagcgcacgatcaaggcacgtcagctggaagagggaatgaagctcttgattatcggacttgcagcaaaagtcgtgattgcggaccggatcggcacactctggaacagcatccggatgatcgggttcgacagcatctcaacaaagcttgcatggatgggagcgttcgcttactcactgcagctgtattttgatttcgcgggatattcgatgatggcgagaggaatcggaaagatgctgggatttgagctcccggtgaacttccgctatccctacatttcaaaatcagtcacggaattctggcgcagatggcatattacgctcggcagatggtttagggaatatgtatacattccgctgggaggcaaccggaagggaaaggcgcgcacctttttcaatctgtttgtggtgtggagccttaccgcgttgtggcacggggcgaattataacttcctgatctggggcgggattctgctttgctgcctgttggtagaaaagctctttctgctgcgcctgctggataaaagcagggtgatcggtcatctttatgtattgtttgttgttccgctcagctgggtggcgtttgcggtcaccgatctgtcggagcttggcgtttatatgacgcggctgttcccgtttgcggggcatgcggcaggagtcatcaatcatctggattatttaaaatatctgaatgactatgcaccgctgtttcttctgggcgtgctctttgcaacgccgcttccggagacctgctatcggctgatcgagcgcaaatggatcggcagggtgatactgctcggcattttcgggctttgcatgtactatctggcggtgtcggcaaacaatccgtttttgtactttaatttttaaatgtgtggtggatggatttgagaaagcttttgaaatgtccggtaacggtcgcactgcttatcttgtgggcggcgctgtcggttgtcggctatctggggaaagatacaatatataagaattatacggttgatatacgaacgacaccatacttcgtcctggtgtttgacggactgcatgacggaatttttccgtggagtcatgtgggtgcgccggacggcataggagagaacggaaagctgccgtccatcctgctgccgggggagagtgtctctgatactgagcttgccggcgggacggagacggtcggagagacagagacggaagaggcgccgcacacgcgggaattctgtatggtggatgacgactggttcgacgacgcggtctttatcggggattcgagaactgtggggctgcgcgattacggcgggctggacaatgcgaccttttacgcgtccacagggcttggaatctacgatatgtggacggaaaagttctgtgaggtggacggggagaagaccacgcttgaggatgcgctttccagacggcagtttggcaaaatttatttccagatcggcatcaatgagatgggaagaggaaccctggacggttttatggagcagtacgcgcagtcggttcagaaatttagagaactccagcccgatgcgatcatctatgtgcagggtatcatgcgggttgcaaaggccaagtccgactcggacaaaatttttaacaatcagggaatcaatgaacgcaatatgagaattgcggaacttgcggataatcagactattttttacattgatgtgaatgatgtcgtatgtgatgcagacggaaacttaagagcggatctcacgtttgacaatctgcatctgtacggctcgaaatacggaatctgggtggatttcctcaagacgaagggaattgcaccgtgaagtggttcttctgaaaagaaatgagaccctcgtctcttagatgacacagctcgttcgacatggcgctccggtctacggagagatagtcggcgagctgttgtctgttaaagggaatatcaaaagacgaacttccggatctgcgcgcctcgctcgacagataggagagaagcttttcacgggtggtccgcttggtcatgtgctctaatttctgtccgagctggaaattgcgctcggcgagaacggagagcagatttcttgtgagctggttgtggaattcacatgcgcgggagcagagcgtcatcatttttgagacgtttaagtagagcacagtggaattctgctcggcgtagaggctgacttccagcgcacagtttgtacggatggcataagattctccgaagatgtctccggggcggcagcgggtcatcagatttgtgttgccccagaaatcctccttcatgacatccacacatccttctaccacaagaccgagagaatccagatggtcgccgtagtgaaagagaaagctgccctttggataggagagggtctttgccgacagacagtcgagcatggcatggatttcttcgggtgcaatatcataaaaaacgggagaggcctgcaagagggcatcgtatccttggaaagtttgcattatttttcgtcctttcgactttttgttgtaaaaacaacagaaatgttgacgctattgtagtatcctgtggaagaaaagtcaagagagaatttccggcatgcgtgccggagttagaatggaggatatgatgttacgaagagtcattgagattgaggaagaaaagtgcaacggctgcggagcatgtgcaaacgcctgccacgagggagccatcagtattgtaaacggcaaggccaagctgatgcgggacgattactgcgacggacttggcgactgtctgccgacctgtccgatggatgcgattcattttgtggagcgtgaggcggcggcttatgatgctgcggcagttgaggagaataagagaaagaaagcagcgcagcaggcgatagcgtcacagccgcttccgtgcggatgtccgggaacccaggcgaagacgatccgccatgagcagcaggcagtctgtccgaccgccgcagaagagagtgcggcagaacttacgtcggagctgacacagtggccggtgcagatcaagctggttccggtgcgcgccccgtattttgacggagcaaagcttctggtggctgcagactgtacagcgtatgcgtatgcgaatttccacaaaaaatatatccgcaatcacatcacgctgatcggatgtccgaagttagacgatgtggattattcggagaagctgacccagatcattgcgcagaacgatattaagagcattaccgtggttcgcatggaagtgccgtgctgcggaggaatcgagcaggcggtgaaaaatgcactcgcggcaagcggtaagatgattccgtggcaggtagacattatctctacggacggaagaattctcgagtaatactttccccttttgcgggacatactatgatgcagaagtatgttacgcgaaaggggattttttatggcacttactatgaaaattacagaggtacacgcgcgggagatcctggattcccgcggcaatccgaccgtggaggtggaggtgaccgccgagacggagacaacggggagaaagactacagcgcgggagtcggttccgtcgggagcgagcaccggaagatttgaggcagtggagcttcgggacggcgacagggagtatttcggactgggcacgaagaaggtggtggatcacgtcaatacaaagatccgggaagcgcttcttggaatgaatgttttggatcaggcacttatcgaccgcagaatggtcgagctggacgggacagacaacaagggaaatcttggggcgaatgcgatcttaggcgtgtcgctcgcctgcgcgaagacggcggcagcggcactcgatatgccgctttaccgctatattggcggaggcaacgccaagcggctgccggttcccatgatgaatgtcataaacggcggagtccatgcgaagaattcactggattttcaggaatttatgatcctgcccattagcgccaaaagctatcgggaagcgctgcgcatgggcgcggaggtatatcatttcctgcgccagattttaaacgaggagggatatgctacggcggtcggcgatgaaggcggctttgcgccggatcttgcggatgccggtgaggtgttccggtatctgggaaaagcggtggaaaaggcgggctatacggtcggaaaagatgtggtctacgcgatggatgctgcggcgagtgaattatataatgaagagacgggaatgtaccatttcccgggggagaatggaatctgcagggatgcaaaggagatgatcgcgctctacgaagatctggcaaagcgttttccactggtgtctatcgaggacggtctgcaggaagacgactgggagggctggcagagtctgaccggacgtctgggagatggcatgcagcttgtcggcgatgatctgtttgtcacaaatcccaagcggatcaagtgcggcatcaaattaaatgcgggaaatgcggtgctgataaaggtgaatcagatcggcacgctgacggaagcgctggatgccatcgagatggcgcagtgtgccggttatcacacggtgatctcccaccgttccggggagacggaggatgcgtttatcgcggatcttgcggtcgcggtgaatgcggggcagatcaaaaccggtgcgccgtgcagggcggagcgcaccgcaaagtataaccggcttctgcggattgaggaggagcttggcgagacggcgcagttttctccggcggagcctttcgggagagcgtaaaaaacagttgaaaacgcggggggagtatgctataatagctaaagttgtgagttgattaccgtaggagggaattattttggcaattttaaagacgattttaaccgttgttttcatactgatttgtttggcgttgacagtcattatcttattacaggaaggaaagtccgcaggactcggagcgatcgccggagcggcagatacgtattggggaagaaacaagggacgttccatggaaggccggctggtgacgggaaccaagattctggttgcgctgttcatcatcattgccgctgtattgaatctgggaatcttttagaaatgaggctgtcgcatctgcggcagcttttttgctgtggagaggaaggatatgagagaagaacttttacaggaacgaaaaaaagcaatttacggactgatctgcgatgagctttatgtgccgatgaaggcgaaggagatcgcggcagtattaaatgtgccaaagagtgacagaagagacctcgcggaagtgctggatgcacttgtggcggagggaaaagtggaagtgtcatcgaaaggcaagtacatgaagtcggaaggaaaattcctgacaggcgtttttaccgcgcatccgagaggatttggctttgtgacggtcgaggaggaggatgaggatatttttattccggaatcccaggtaaacggtgcttttcacggcgataccgtgcaggtggcgctgacacgcgccgaggggcacggacggcgcagagaggggcagatcacaaagattttgacccgcggggtcagccggatcgtctgtacctatgaaaaaagcaagacattcgggttcgcagtgccggataatccgagatttggacaggatatttttatcccgcaggagcgctcgaaaggtgcggtgagcggacataaggtcgtggtggaactgacggatttcggcggcaatggaaaaaagccggagggaaaggtcgtagagattctgggacatgtgaacgacccggggacggatattctctcgatcgtgcgaggttacgatctgccgaccgagttctcggagaagatcatgaatcaggtggagcgcgtggcaggtgaggtcagcacggccgatatggcaggccgcatggatctgcgggactggcagacagtgacgatcgacggagaggatgccaaggatttggacgatgccatcaccctgacgaaggagggggatgtctaccgcctgggcgttcatattgcggatgtcacgaattatgtgcaggagcgcagcgcccttgacgtggaggctctaaagcgcggcacatcggtctatcttgtcgatcgtgtgattccgatgcttccgcatgcgctttccaacggcatctgttcgctgaacgccggggagaaccggttggcattaagctgtatcatgaccgtggatgcgaagggaaatgtgatcgatcacgtgattgcggagacagtcattaaggtcgaccgccgcatgagttacaccagtgtcaaaaagatcctggaggatcacgatgaggcggagatccgtgagtatgaggagcttgtgccaatgtttgagaggatgcgggatctggcggcgattctccgcaaaaaacggatgaagcgcggatcgattgattttgatttcccggagacgaagatcattctggacgcgcagggacgccctgtggagatcaagccgtacgagcgcaatgttgcaaccaagattatcgaagattttatgctgcttgccaacgagacggtggcacaggactatttctggcaggaactgccgtttgtgtaccgtacccacgacaacccggatacggagaagatccacaagctggcaacgtttatcaataattttggctattcgattcatatcgggcaggatgaagtacacccgaaggaactccagaagctgctgcttcggattgacgggacgccggaggaggcgttaatcagccggctgacactccgctcgatgaagcaggcaaagtacagcaccgtaaacaccgggcatttcggactggcaacttcctattactgccatttcacctcgccgatccgccgttatccggatctgcagattcatcggatcatcaaagacaatctgcgcggaagaatgaatgcgaagcgcatcgagcattatgagaagattctgccggaggtggcaaagcattccagcgagatggagcgccgggcggatgaggcagagcgcgaatgtgacaagttaaagaaagtacagtacatgtccggacatctgggggaagagttctggggtgtcatttcgggcgtgaccgagtggggcttctatgtcgaactgccgaataccgtggagggacttgtgcatgtgacgacgctgacagacgactatttccactacagcgagagcacctatgagctgatcggggagaccaccgcaaagcgctacaagcttggtcagaaggtaaagattgtcgtggcagcgacagattcgtttatgcgaacgatcgactttcgtgtcgttaccggaacagaagacgaagaaaatgaaaaattaaaccagaagtttattgcagaataaaaatttgtggggtatactgtaacagcagtgcagatgaaaagcggcagtgcagacagtaagcgaaggaggatagtcgggatggcaaagaccgagaagaagttaatcgcgaataacaaaaaagcctaccatgactatttcctggaggagcggtttgaggcgggcattgaactgcacgggacggaagtgaagtccatgcgcatgggcaagtgttcgatcaaggaagcgtttgtgcgcatcgagaacggtgaggtcatcgtctacggcatgcacgtcagcccttatgagaagggcaacattttcaacaaagatccgctccgccccaagaagcttctgatgcacaagtcagagatccggaagctgacgggaaagcttgcagagcagggctacacgctggttccggtggaggtatatctgaagggaagcctcgtgaaggtggagattgcacttgccaaaggtaagaagctctacgacaagcggcaggacattgcgaagaaagacatgcgccgcgaggcagagcgtgatttcaaggtaaagaatctgtattagattttttataaataacaggggccagtaaaggtttcgacggggaatatgaagctggagaagcgagccgcacgggatgcgtcaaattccacaattaaatttaaacgctgaagataatttagcatacgctgcctaatggcagcagtctgacctagagcactcacactttaggacccaggcttcgacgatgtgagaaacgacacaggcaaagctttgagcctgcgggcgtaccatgaagctaccaaaaccgtaagggtgtctgttcccggacggcagagggaatgtcaaaggacagactaagctcgtagaaggacaggggattattcttcggacacgggttcgattcccgtctggtccacttatcaactatgtgacgaacccactattcgcattatgctttatgagaatatgtggcttgtatcgaagataatcgcatgattggtgatgtagaatgaaaaaggggcgtaagccccttttttatatgattgtaaatagtcgaaaaactcaaaacaggctacgggggtttttagactatcaatatttattgactgtctaaaaactgtttgacagtctaaaaacttctaagccttgtagattctggggttgacggcattttgtattaacatttttattctctaagaacattgttttataaaaaaagcgtccccatcgtccccaaagtggcgcaaagccttgtaaatactacgcacaaggctggggacgctccacgccaaggtagcgtccccaagcgtccccaagtcccccaagcgtccccaagtccccaaaacgtccccagcctcaaaaattgtaaatagtcgaaaaacgtctttgtggcaacatggttttatcataaacggaaaactattgaataccaaacgtttttgcaggaatatcaattcctaccatttttccgaaagccaatgcccatttgacaaaattgtatgatattgatgtgattatattgccagttataatatatccatccttaatgggcttgtttatattgtcatcccagctcaccatttctgctaaatcactttcggaaaatccttcttcaaaaatctcttctttattgacaccagccatgaacggttttccattaagtaatccggctctgacaagtaacagaggtgcaattgaaatagctcctattgtttttccgtcaaactttttgatgaaatctattatttttttgttttcaatagcctctctgatatccattgcaccaggcaatatcaagctgtcatacgcatccaaatcaaaattatcaatagtagcatcgggaattactgataatccatcttcacttctgattgcctgttttgaaatcccaaaaattgtaattggtttttcagcgagtgccaatatctcaagcgcaggactgatttcaaaattacaaaatgaatcatataataatacggcagtttttttcatatcaattttcctccatatacaaattcagtctggtaaattacctttttaattgtaccatatagttctaaaaactcaaaagattattttgctcacttttcccgtgtttactgagaaactgcttattaagaaaggattgtaaaaggtcgagatattgattgacactgtctaaaaacagtagtattctatttgcaacaacatataagcggtgttcacgaagtgcgtgcatggtttgaacgataagttcatgaagtctatgagggtgcagactaaactcgtaagacaaagttttatatgctccatgtcagctagtcataccagctgtgagaacaagcagttgcgaagttaaaagcggtgaacaggaaagtgtatagcatagctatacgttttcctgtctgccgcttttttgtgcctaaaattatttaaaggagtgacgacatgcttgaaacaagaaaaggtggacgaccgtcaagacgacctgataaagaaacgctccagcatttatcagacatgctgacaatagagcagattgctcagctctattgtgttgaccgttctactgtttgtaactggaagaaatattatagactgccaccaaagattggacgcccaacaaagcgtccgtcagcacgcaaattaagaaatctgtgcaaaacatgttcttacatggaaattggtgggcgtttaggtgtttcacctagcacagttgcatcatgggtatatttctaccgccagaagaatgagaagaaaggtgtgtgatgcgttatgaatgacatgtttcttgatgatataaaaaaagatgtgtccgtgactacctacacagacacatccacaagtgctatacacacttatcctgatgacgcaattataactgacattataaactgtgtcaatactgcttttccagacaccagcagacaacagaggatgatatatgttcataaaatcataaattgtcatagaccatacagtgacggtggcattgttcctaatccattgactgataaagatgctcagaactatacgattggatttaggtcaaagttgcgacagttcgcttttaaaatctatattgaacagttgccaaatggaattattgattttataaagcgtgtgcaaagtgttgaaaaaacaacgtatcaagtgattgcgattatccatgacagagatataaaacttgatgtgcatgacttgtatgcagaagcaaggttaaaaccacacattcacattattgtacgttgtactgacagtaaaaaacgtgttcacgttcagactgttatgaacatgcttggtattattttccgaaaaggcattgatgatgcactgatagtacgaaacaagggcatagatacaattcataagaagtttgctattgcaacaacttatctcacacatgatacagaagatgcggcaaaacataaggaacattatgaacttgatgagtatataagtaatctgtccattgaggaaattcagacaatcagggatggatatacaaggctgacaacatcgacgaacaaagttgataaacaacgcatggctgaactggatgaatatgcttttaatataggctatgaattaaaagattttgatgagtggtacaataccttatcatttgctgagcgttgtaatgctagtatgaaaactgtgcaggaaagttatatgagagggtgtcagaaaaaatttgatgaacgtgtgccaattttacgcaaatgtattttcattcatggtgcgccgaatactggcaagacttatgcgactgaacgggctttggcaggcaggaaaacattacatgttggtggcggtggaacaggtaaatttgacagtttaaaaccaagtcatgatgcaattattgttgatgatgatgtgtgtcctaatctattgaatatgtcggacaattacgcatgcaaagcatacagacgaggcagaaataatcctatctgggctggcgagtggcttattgttacaagcaacttaccttttcgcgagtggcttttcaaatgcggtttttcttacaaagaagaagattcacacgtaaaggcaatgttctcacgattttttgtatgcaaagtcgtgggtgatgatagttctgctgaactttatctgctaaatccaagcacacggggattggtcgaggagcagaaacaacgcatgagggattttctacaatttcagaaagtctttaatgatacaatccaaaactatcatgcagagaaaagcagaaatgattttgatgcttttgcttttgtaacaaaccactgtccgttcggtgactttccagaacgacaaaaaaaggcatttgctagtctttatgacaatggttcatagaaaggagaagaacatgaaaacggttaatcaattacaggcggaacttatgaaacagaaagaagcatatcagacttcacagaagaaattaaaagcggagttgcgaaaggcacagaaagaagctgagcgtgaagcacgaattgcagaacagaagaagatgaacgaagaaaataaaatcgtatgcgattttcttcgtactaattttggtcaggatggtgtgctattgttcgatacattacttcaacgagcaatgcaggcgaacaatgagaaacagtcgtaatgcgcgaaaaagggggtaggcttcgccagggggatttccccctatgagaagggtattgcgggttgcttgcaaccccaatgcccagttacattgggattagaactaataacaatgtaatgaatatgctacggagatagataatctacagaaagaggtgtaacttatgggctttcaatgctgtccgcaaataatgggactacaacgacaggggcatgttacaaaatcaaacaagcgaggtgctggaaaatttatatgtgctgagatgggagcggataggatttcatcgagtgaaataatcagacatgaagattcaaaacacaacacatatacaaattatattgatggcgaaaacttttccagcggtttcaaactctgggactatatcgagaaacagggagatactattgaagttaagtgtacagacaaaagaacgggtcaggaagttataagatatagaaaatcaaaggctgacgctgtgcttggttatgcctatgttattaagccgccggctgaggtaacagagcaatggacggacgagcagaaagcgaagttctatgaagatagttttgatgctatgtgtgagataatgccagaagtattttcacatgagaataggctgttcactgcgatacatgttgatgagggattctcccttgcggatgagcatttacatggtgcaggaataccacgaaatgctgatggcaagtatacaggcaatttgattgatgccaagcatctatctttgatgcaacaggaattcccgaaacacatgcgtgataaggggtgggatattgaagataatgatgtgaccgactggcaaaagtataatactgataaacaatatcgtgatgagcgaaaggtttatcttgaacagaaaaagaaagatggaaaaggtggattgacaccgaatcagtaccgcaagtttttggcgcaaaaaaaattaaatgaggcgaatgaaattcttattgatgcaaagtctaaactgggagacgctataaaaacttataatgatacgcttgctacgcagaaaaatattaagcatgaaatagatgttcgagctgatgcattggctgaccgtaaagcagaagaaacgatacaacagtacgagcgcgagtttgattatcgtgtcaatgcaaaagctcaagagattactgcaccgatacaacaaagttgtgaatgtgcgctgaaagattataataatagaattgcgaatattgataatgctgttgaagaacagatgcgtctttacattgaaagtcaaaaaaatgaggatacgcctgaaatgaaacgagtgaaacaatttcttgcgtctagggttagttccaaaactaaaaaaagcgaactggatgtatataacgaatatgcacagcatcatccactagatagaacagagcgcatacgacgcgacacacaaagaattgcagatgcagttcggaatactgactggtctgcatcccaatggcagttagactagtaaaaatcatattgcaaccctgcaccccgcttgctataatccaaagcagaaaggggtgctttttttgaaaaaatataaatataatgacaataaccttgcaatctgttactatcgcttttcatcacatgctcaaaatgaagcgtccatagaccaacaacgagaacaggcaaaattttttgcacaaacgcatgacttaaaaatcataaaggaatatagtgatgaagcaatctcaggaacgacagataaccgccctggatttcaacagatgctctcagaagttgcaaagctgaaacctagcacgcttatagtttggaaagttgatagattagggcgagacagaactaatatcgcgattgctaaagatactttgcgaagagcaggttgtcgtgtcaagtatgttgcggaaacagtggcaaacgaggacacaccggaatcacagtttactgaggcgatgttagagtcgatggctgaattttattctgcacaacttagggttaatgtcatgcgaggtatgaggtataatgctgaacatgcgctgtataatggtcacaagacactgggatatgctgttgacggtgaaaagcattatgttatagacgaggaaacagcaccagttgtccggcgtatctttgaacaatatgcatcaggtgtgccaatgcaacagattatgaatgaattaaatgatgcaggaatcaagacaacacgtggaaatgaatttactattaacagtttacgtcatatcctgcataacagggcttatataggcgagtatcattataatgacatagtcatacctgatggtatgccctctattatcccctgtgagctgtttaaaacggcacaggaacgctttgaactgaatagacggataaagtgccacaaaagcagtacaatggctaaaaacgtctctgagagccgtttctggctgacaggaaaactatactgtggaaaatgtggggaaagcatgcatgggctatcaggaacgtctaaaacaggtgctacgcattattattacgcatgcaataatcacagaaaacacaagtgtaccctaaaaaacataccgcaacatcaaatggagcttaatgttatatcaattttgaaaacatttttgaatgatagtgagaatcttgcatcgttggctgtagacatagcaaattaccacaagagccggaatgataattctgcttttattgccagtctggaagagatgcttaaacagaatgaaaagcagataactaatattgtgaatgctattgctaatggcgcaatgtcttctgcgcttactgataaactccaacagttagagatagaaaaaggttctttgacggatgcaatcgaagtggaacaggcaaaggcaagactaattgtagatgaacattctgtaaaagagtattttaagcagtacgctaatgcaaacttagatgatgcagaaataagagattctgtattgaattattttgttgataagatttatgtctatgatgataaaattacagttacaggctgttttagtggggaaccgacggaaataccgtttacagagttttcagagttcgactgcgaaacagtcagctccatcttaaaaagcgccatgcagggcgctttttttatgggaaaatgcggaatctttacatctccctgacttgcaattcacactgccatttcctataataagagcaaaatcacagcagaaacggaagagatgaggatcgaagaatgtctgtagaaaagagacaaaaagaacaggaaaagacctccatggtcgtggagggatttttatttgcaaatgaggcggaagccgcgcaggcgagaaaagaggcggagggcgtgaaatacgtcaaggagaaagcccagatggacgaccctgagatggtactccgcatttataataaaatgatacagcagcggctgtttgacacggcagtcggctattcttatctgaaggatctgcaggagtatctgcagtcgattccgtttatccggaaggaagatattttcccgattccggtgcagcatccgcaggtggaggagagtctccgcaaggcgaagcgcgcgccggcaccaaagccgaagacgcagaccgtggtaaaaaatgcggactacaggagacgctaccgcattgtgcgctggatcgcctttattctggcagtatgtgttgtggcgatgtttgcaattacggcgacgaccaataatacgacggtgttaaactacgagaatcagctgatcaacaaatacgaggcgtgggaggagcggctcgaccagaggcaggaagcgatcgaggcgaaggaaaaagagcttggaatcatgccggaatagagcggaaaatacacagatttttcataagtagctgttagaatgacgataaaaagcggaaaggatacgggaacatggataagatcagaattctggtggtggatgatgagagcagaatgcgcaagctggtgcgggatttccttgtgagagagggatacgaggtgcttgaggcgggagacggcgaggaagccctcgatttattttaccgggaaaaagacatagcgctgattattttagacgtcatgatgcccaagcgcaacggatttgaagtgtgccgggagatccgggagacatcgaaagttccgattattatgctgacggcgaagggcgaggagagcgacgagctgaacggatttgaactcggtgtggacgaatatatttccaaacctttttctccgaagatactggttgcgcgtgtcggagccattctgcgccggagcggaaagacgcaggatgaagaagcggcggtctccatgggaggaatcgttctggacaaggcagcccacatggtgacggttgacggagagcggatcgatttaagctacaaggagtttgaactgctggcatactttatggaaaatgcggggattgcgctctcacgcgagaagatattgaacagcgtctggaattacgattactttggcgatgcgagaacgattgatacgcatgtcaagaagctgcgtgccaagatgggagataagggaaaatatatcacgacggtctggggcatgggctacaaatttgaagtgacggaagaataatggaagtgacgcggaatgaagggactttttgataaaaagagacaggggcgcggcagacatccgaaagagggcggactgaccagggaaatcgccggaattatcatcggtctggtggcgggaaccgtggcgctctgctgggtgcttaacacggtatttctggagcgctactatgtgatgaacaaagaaaatgtactgctgtccggatttactacgattgacgcggcaagcgaggatggaagccttgacgacagctcgtttgatgtgacatttgacaatctctgcgcaaacggcaatatcacggtcatggtgatcagcccggaccgcacgattgtcagatcctccgtgaacgatacacagcgtatgttaatcgagtttacggacattattttcggtggtacgcagaatgagaccacggtgctggcgcaggcggaggactatgtgatccagagaagaacggacaccaggctggatgcggaatatctggtactgtacggaaccctctcaaacggcaatctggtgctgatgcggtcggcgttagagagcataagggagagcgccaagacgtcgaaccagttcctgctgtacgtcgggatcctggcgattgcggtgagcacggttgtgtcggtcttcatctctaagagaatcaccgatccgatcctggaactgaccgagatttccaagcatatgacccagctggaatttgaggtctgctatacgccgaaaggaaagcggcgcaatgagatcgatgaactcggcacgcacatgaacgagatgtcgcaggcgctcgagcatacgatctcggaattgaaaagcgcaaacaaccagctccttttagacattgagaaaaagacgcagatagaccgccagcgcaaggaatttctctcgaatgtatcgcatgaattaaagacgccgcttgccctgatccagggatatgcggagggcttgaaggaatgtatcaacgatgacgcacagagccgggatttttactgtgaggtcatcatggacgaggcggataagatgaatcagatggtgaaaaagcttctgacattaaaccagctggaatccggaaacgagacgatcacgatggagcgcttcgacgtaacagagctcatccggggcgtgctgcactcggtggatatcctcatcgggcagagcggcattacggtgacggaatgtcccgcagagcccatttatgtgtgggcggatgaatttatgacggaggaggtcgtgacgaactacctgagcaatgccattcattatgcgggaggaaaaaaggagatttccatccgctgcagggagcaggagaagaacgtccgcatcagcgtcttcaataccggagacccgattccggaggaggatatcgacaaaatctggtccaagttctacaaagtcgataaggcacgcacgagagagtacggcggcagcggaatcggtctttccattgtgaaggcgatcatggactcgttccatcagcagtgtggcgtgatcaaccatgaggatggcgtggaattctggtttgaactggaaaaaggaaaacagtcatgatgcagcaaaaaattttttttgttgctatatttcctttaaaatgctaacataatgttagtttatactttgcgtgaggaatggagtcctatgagaagaacaagaatcaagatgatggcagcggtgatggctgcaacgatgctgttgggcgggtgtggtgatgcactctatgacctgacagacgacgaggagaacgtcattgtcaattatgcggcgcatatcgtcacgaagtacaacacatatcagcgggaaggtctgacgtatgtgagtccggaagaaccggaggagacgcaggaggatgtcacggtgccgcagacgccggagacacaggacgcgtcagagacgggaacagccgcatctgcggaagctgcggcacctgctgtgtcggtggcggcagccggatcggcatctctggatcaactgttcggagccgacggcattcagatgacctatgcgggcgcgcagcttgcaccggggtacatggaaggtgattattatgagatgaccccggatgccggaaaacagtatctggtgctgtccatagatgtgaccaacaccggggcggacggagtgggtcttgatgttttgagtgtcagcccgaagttcacggttgtattgaaccagtcggtcaagagcacggcggagaccacattgctggatacggatttttccacctatcagggtacgattcctgcgggagggagcacccgcctggtacttgtattccaggtgccggatgatgtggcgtcggcagacagtgtggaactgtatgtgcaaatggatcaaatgatacaaattattctgtaaaacgcatgaaaaacaatgcatttcaggtaccaatgtgctataatgctgtcagatagatacgttgcggtattacgcgagaggagagagacgaatggatacaaatatattattggaatcgggaacaaacgaactggaagttctggaatttaccttgggaaacaatcattacggaatcaatgttgcaaagatcagggagattttaacctatcagccggttacgcctgtcccaaattcacatccgagtatcgaaggaatcttcatgccgcgtgatacgatgatctctgtggtaaatctgaagcgctgtctgggaatgccggatgatgcgaagacagagggactttttatcattacgaactttaacaagttaaacattgcatttcacgtagatgccgtgcttggtatccaccgtgtttcctgggaggcgatcatcaagccggatgccacgatcaataccgagcagaacagcgcctcgaccggtgtcatcaagatggatgacaagctgatcatcatccttgactttgagaagattgtgacggacatcagcccggagacaggactgaagatgtccgatatggacgacatgggacagcgtgagcgctgtgaatctccgattttgatcgcagaggattccccgcttcttagcagactgatcacagactgcctgaagaaggcaggctacacgaacctgattgtgacaatgaacggtcaggaggcatgggataagctgcaggagtttgaaaaagcaggcaatgtgcgtgagaaagtacactgcattatcacagatattgagatgccgttgatggacggacaccgccttacgaagctggttaagacaaatgacaatatgaagaagattccattgattattttctcatctcttgtaaatgaggagatgcgcatcaagggagaacagcttggagcggatgcccagctgacaaagccggagattggcagtcttgtttcggcgattgacgacttgattgacaagagcatggactgagaatgaaatgaagaggggatgtgatggagcaggatcacatcccccgcttaagttataggtcgatggaggtatcgtatgagcggagcagaggaatatctggatgggctgctgcactccgtagagggaggaagtcctgccgacacagcccgtgagacggagccaggcgatacggcagacgggctttatgcagaaaaagaacaggagacaaaaaaagctggtatgagtgaggaagacgattttttaaagtcctttgaggcggatacagatctggaaggagatgcggacacatttatcagacagttcgaggatgagctggatcaggcgcctggagaggaaagaacacagaagacgacggaggagaacaatcagttcttcaaggatctggatggcattttagacagcgcaagggatgcggatgagagcaccggcggtgcagaagcggcggagactgcccatgcgtcggaggacggagatcttatggtcgataccattggtgatttccaggacgacgattcagatctgatggatctgctgcagtcggagggcgatttcccggatatgagccagatggcggatcccactgctccggccgcagacacagacgcagaaatgccggacgtgacggcaatgccggagactgcggatgaggtgcaggacgaggacgacgggaaaaagaaaaagcgccgcaaaaagaagaaaaaagatgagccagatgccggggatgaggctcctgcaaaggagaaaaagagcctgatcaagagaatcggcgacgcactgtttggtgaggaggaagagacggaggaggcaccagcggacaccggggaattacagccggaaggtttagaacaggcaccggagctggatgatctttccgatgagaatttaaagctcttacaggaactggaaggaacgggggcagccgagccggagacagaggcggaaccggagatttcagaagaagagaagaaagcgcaggcaaagaaggaaaaagcagagaagaaggcgcaggagaagaaagagaaggcggagaagaaggcacaggcgaagaaggcgaaggcagagaaaaaagcacagaaagccaagaagccgaagaagccgaaggagccggacaatacaccgccgcttccgaaaaagccggtggtgctgattatggtcatggcggcgtctttcctcgcacttgtgctggtgggaacgaatctgttcggatataccctgagcttcaacaatgccaagcaggcgtatgaactgggcgactatcaggcagcgttcgcggatgtgagcggacttacggtcaaggaggcagatcaggagacctaccagaagtacagcatcatggcgaatgcagccggagaatatcaggcataccagacctttatggaaaacggtatttatgacatggcactggattccctcatccgcgcggtcggaagatgcgataagtacagcgaggaggctgcggcttacggctgctccacagaactcgcgaagatcagagaccaggcggtggcaggactgtccggatttggacttacgcaggagcgcgcacaggaactgtacgcggagagagagcgggatacttactcgcaggaactgtattcgatattggcggcagcaggacttggatgacatcgacggagtgagagaatgatagcaattatagactatgacgcaggcaatttaaaaagtgtggaaaaggcgttcctcgcgctgggtgaggaatgtgtggtcacgagagatcatgacagcatacgccgggcagacagagtggtactgccgggtgtcggttcttttggaacggcaatgcagcagctgaaaaaatatgagctggatcaggtgatccgcgaggttgtgcaggaagacaagccgtttctcggcatctgtctgggtctgcagctgctgtttgagggcagcgaggagagtgacggcgtggagggacttcatctgctggacggagagatcgtgaagattccggaggcgccgggacttaagatcccgcacatcggctggaattcactggatttcccgcatgaaggaagattgtttgccggattgaaggaacagccgtatgtctattttgtacattcctactacctgaaagcgaaagatccgtcgattgtgaaggcgaccacagagtacggcgtgacgattcatgcttccgtggagaagggcaacctgtttgcgtgccagtttcacccggagaagagcagcacagtgggacttcagatactgaagaattttgcggaaatatagcggaggcatgcgatgtttacaaagagagtgattccctgtctggatgtgaatggcgggcgtgtggtaaagggtgttaattttgtgaatctgagggatgccggagatccggtggagattgcggcagcttacgataaggcaggtgcggacgaactggtatttctggacattaacgctacctcggacgccagaaataccgtggtcgatatggtgcgccgcgtggcggagagagtgttcattccgtttacggtcggaggcggcataaggacggtggatgattttaaggcactgctccgcgagggcgcagacaagattgcgatcaattcttccgcgatcaaccggccggaactgatctcggaggcggcagacaaattcggcagccaatgcgtggtggttgcgattgacgcaaggagacgcgcggacggctccgggtggaatatctataagaacggcggacggattgatgtgggtctggatgccgtcgagtgggcgatgaaggcagaccggcttggcgcaggagagattcttctgacaagcatggactgcgatggcacgaaagcgggatatgacattgaactgaccagacaggtcgcggaaaatgtatcgattcctgtgattgcttccggcggcgccgggacgaaggatcatttttatgatgcactgacaaagggaaaagcggatgcggttcttgcggcatccctgtttcactataaagaacttgagattatggatctgaagaacgatctggcagcgaggggcgtatctgtgcggcgatagcacggtgcgcccacactgctgtctgtgaaaaaaggagtagtgggatatgtcgatgattgacaatgactggcttccggcaatccagggggaattccgaaagccgtattaccgggaattatacacatttgtgcgggaggaatacagcagaacagtggtctacccgccggcggaggatatctttaatgcctttcattttacgccgcttagtgaggtgaaggtgcttctgttggggcaggacccctatcacaatgtaaatcaggcacatggtctttcgttttccgtgctgccggagcaaaaggagatcccgccctccctacagaacatttataaggaactgcatgatgatctgggctgttacattccgaataacggttatctgaaaaaatgggcagatcagggagtgcttctgctcaacaccgtcctcaccgtgcgcgcgcaccaggcgaattcccatcagggaagaggctgggagcagttcactgatgcggtcattcaggcagtaaatgcccaggatcgtccgattgtgtacctcctctggggcagaccggcgcagtccaaaataccgatgcttacgaatccgaagcatctgatcttaacggcaccgcatccgagccctctctcggcataccggggatttttcgggtgccggcatttcagcaaggcaaatgcgtttcttgaggagcatggaatcgcaccgatagactggcaaattgagaatatttagtgtataatatacttacaataaaagcagacaggaggtattggttatgcgtgtaaaagcaattatgatgcctttcagtaagctggcgtgtatcagcgtggagaatacggtagaagaggcaatgaagattatcgacgagcagggacttctctcgcttccggtagtggacggacagcagtttgtgggtgttttgtccaaacagtttttgtttgaggaatttttccggaactatacagggaccagagaagaatttgcacagcgaaaagtgatggagttcatgaagacaagaattgagaccatcggtgagaatacacggattgaggaagcggcagcaatgtttatcacctccaaagttcgttttattccgatcacgaacgagcagaacaagctgcttggaatcgtgacgcagcaggcggtattcaaggaatatcagaagatctttggtaacaaacacaattccatggcaatctacacgtatgatatccgaggtgtgctcggcaagatctgtgagctgattgctaaggagggcggagacatctgcaacatgatggtgattccgacggatgttatggatctggcagagatcttccttcgggtggaagcaccggattttgagcgtgtggtacgcgcgttagagcgccacggttatgatgtgcgtgatgtgaagtataatgatcagaaataatacagaacggatggatctggaatagaagagaggggtgccgcgcatgtgcggcgcccctctctgtctgcataaaagggagctccctaaaatgaggagtgcccagacactcgcgcgcctgggctattatgaaaaaattatcaaatatattgtaacgaattgtcttgttttttgataattttattgtagcaataagatatgaataaactatgaacaatagttaaacattttaataaggacaagcaccagaaaatgcttgaaaaatctaaggtttcgggctaaaatgacgatatagaacatgaggtaacaagaaggtattgtgcacaaatgcaacagccggatcaacattctgacacggaggtcagatgctttttttcaaaggagtgatagagtatggcaagtatttcaggatatgattcatcgtcactgggcgtgttattttccagtctgaaccggaacaatacaacttcctctctgctgggaggcggaagcgatctgctcggaatcaattattccgattatgcgacgatccgcaacggaagctatttcaagcttttgagtgcctattacagcaagtcggattccacggacagcgccacgaaggtcagcccgtcgatctcaaccgcgaaggatgacgcgaagacactgacccggattgagagtgcggcggagagtacggagaagtcgctttccaagctgacagcaaccggaaaggattctgtgttcaacaaagtggagaagaccgcggaggacggcacgaagacgcaggagtatgaccgtgatgccatctataaggcggtgaagtcgtatgtggatgattacaattcactgctggatcgggcggacgattctaagacgaagagcattctgcgtgcggcgaactctttgaagagcaacgccagagcgaatgagaagacgttggagaaagcgggcattaccgtggatgccgacggcagactttccgtggacgagaagagctttgagaaggcggatatggacaagctgaagtcactgtttacaacgcacggatcttatgcgacgcagacgaatgtggatctcctgaagatcgcatccaacgcgaagagtgaagcggcgaaggcgaatacctacagcaagaatggtatgtatacttataattacagcaccggagatctttacaattccggaatttaacattggaagacacgaagagatgaggctgccataccgtaaggtgtggcaacctcatatgtttgttggcaggagcgggcatggcaggaaaaaaagtagtagtcggtatgtcgggcggagtggattcttccgtggcggcatatttgttaaaacagcagggatatgatgtgatcggagtcacaatgcagatctggcaggatgaggatcagtttacacaggcggagagcggcggatgctgtggactctcggcggtggatgacgcacgcagggtggcggatcgtctggagattccgtattatgtgatgaatttcaagcgcgagttcaagaagaatgtcatggattattttacagcggagtatttaaaagggcgcacgccgaatccgtgtattgcatgcaaccgctatgtgaaatgggaatctctgcttcagaggagcttggagatcggagccgattacattgcgaccggccactacgcgcgcgtggaacagctttccaacggaagatatgctatccgcaattccgtgacggcggcaaaggatcagacctacgcgctgtttaatctcacgcagaagcagctctcccataccctcatgccggtaggagattacacaaaggatgagatccgtgcgattgcggaagacatcggactgatggttgcacataaaaaggacagccaggagatctgttttataccggacaatgattatgccggatttatagacagagagtgcggggaaatggtcccgccgccgggcaactttgtgtcggtggacggagagattttagggcggcacaagggaattacacattatacgatcggacagcgcaaaggactcgggattgcgtttggatatccggtgtttgtgacagagatacgcccggagacaaatgaggtggttctcggaagtgataaagatgtgtatacaaaccggctgtatgcgaatcagctgaactttatggcgctctccgacattgaggagccggttcgcctgaaggcaaagatccggtactcgcatgcgggaagctgctgcaccgtgcggcgcaccggtgcggatgagatctgctgtgaatttgaagagccggtgcgcgccgtgacaccgggacaggcagtggtgctgtacgacggagactatgtcgcgggaggcggcgtgatcacacacgcttaagcgcctgcatcacagggcaaacgtgcggattgcatgcgcgacgccgctgttttcattggagcgcgtcacaaagtctgcgatctccttcacttccggcagggcattttccatggcgacgccgatcgctgcggtttttaaaatgtcgatgtcgttctgggtgtcgccgcaggcaagcgtctcttcgatatcgacgccgaggtgcgaacagagcagggtgagaccgtttcctttggtgacgcccgctctggtgaattccagattgtggtagccgccggagagaaaggtgatctcggggtgctctgacaggatctgcatcacttcgtcgcggtagagaaaagtgccgtcctcctgcggataaaaattcagcgtcatcttctggacgttcagattgtggacgcggatataggcagcgagatcatcggtgaaggttctggtccggtgaatgtagcgtttgattgatgtgggcatgtccaggcagtcgatctttccctcacaggaacgctggctgaagccgtcgccattgataaaagcatccatatggatgctctttttttgcagttcttcgatgatggggcatacaagcgcaggctccatcgcagattcatggatgcagaggcggtccggcagatgatagacggcagcaccgttggaggtgatggcataggagacgccgagaccggataaaagtgtgacgggaagcccggcgtaagggcgtccggtcgatatggcaacgtgaattccgcgggaggaagcttcgcgaatggcgtcctgatcctcctttgagatctcactttgtccgttaaaaagagtgccgtccatatcgagggcaatcagactgacaggctgtttcatagtcgagtatcctttctgtaaatgtatctacagaatgatacaataaaatgggaaaacaatcaagaaacggcggtgccgtggcgcggattgcaggaaacattggaaaatacttgcacccggcatggggaaatggtaagatgtggcttgataagcgagaacggatgatagagaggatacgggaatgaccagagaggaatttgcaacacttgtgggaagcagaccggtgatattggacggcgcgacaggaacgaatctgcagaaagcaggaatgccggtcggggtctgcccggagcagtggattctggagaacccgggggttctgatagaattgcaggagcgctatgtggaggcgggcaccgatattttgttcgcgcccacctttacggcaagccggatcaagctggaggagtacggactggaggattccctggtgcagatgaaccgtgagctggtggcgctctcaaagcgcgcggcaggcggcagggcatatgtggcgggcgatctgacgatgacgggacggcagctttatccgctcggcgatctgatgtttgaggatctggtagaagtctacaaggagcaggcgaaggtgatctgcgaggcgggagcggatctttttgtcgtggagaccatgatgagtcttcaggaatgccgtgctgcggtcattgctatccgcgaagtgtgtgatctcccgattatggtgtcgctgacctacaatgaggatgggcggacgctctacggaaccgatccggcgactgcggtgattgtgctgcagagcctcggagcggatgctgtgggactgaattgctccaccggaccggaggcgatgattgatccggtacagcagatggcggagtatgcgacgattccgcttctggcaaagccgaatgccggtatgccggagctctgtgacggcgtgaccgtataccgtaccacgccggaggagtttgcgtcagtcggcgcgaagcttgtggaggcgggcgcggcgatcatcggcggatgctgcggcacgacaccggagcatatctgcgcattaaagcaggcggtgggttccatgccggtgcatatgcctctcacaaagaaaagacgtatgctcgcctcggagcggatgcatgtggagatccggcttgacggtaagttcatggtgatcggagagcggatcaatccgacaggaaagaaaaagctgcaggcggagttaaaagagggaagtcttagtatggtgcggaccatggcgacggagcaggaggagaacggcgcacagattctggacatcaatatgggaatgaacggaattgacgaaaagcagatgatgttagacgccatctatgaagtgacttccacggtagatctgccgctctgcatcgattccagccatgtggatatcatcgaggcggcgctgcgcatctatccgggacgtgcgcttgtcaattccatttctctggaaaaagaaaagatcgagtatctgctgccgatcgcgaagaagtacggtgccatgtttattttgctgccgctctcggacgaggggctgccgaaggattctgcagaaaagcacgggatcatccgcgagatcttaagacgcgcggaagcgatcggcatgggaaaagaggacattgtggtggacggactggtggcgacgatcggtgccaatccgaaggcggcgctggagtgttttgagacattttctttctgcaaaaatgagatggaactgccgacggtctgcggactgtccaacatttcgttcggacttccggagcgctcctatgtcaacacggcatttctcacaatggcgatcggaaatggccttacgatggcgattgcaaatccttcccaggaacttctgatgaatgcggcatttgcatcggacatgcttctgaacaaggaggagagcggcatccgctatatcgggcgcatgaattatctgtccgagaagcatgagggcatggaacatgtgtgggtacctgtcgggacggcgaagggcgctgccgtgaaaggtactgccgcgggacaggcgggaaacgcaggcggcgcaaaggattccgggaacgcgaatgaggcgcgcagtgcggtttttacggcggtcttaaagggcaataagaatcatattttagacgaggtcaaacatgcgttagacaccggggagaagccggatgacatcatcaacggacatctgatcccggcgatcaacgaggtcggcgagctgttcgacaagcagaagtattttctgccgcagctgatttcttctgcgaatacgatgaaggtggcgatcgaatatttagagccgatgttagcacgctcggacaaggagccgaaggcaacgctcgtcgtggcgaccgtggagggtgatatccatgacatcgggaagaatcttgtggtgctgatgctgaaaaattacgggtatcatgtgattgatctgggaaaagatgtcccggcagatctgattgtagataccgcgatgaaggaaaatgccagggtgatagggctctccgcgctgatgacgacgacgatgatgcgcatgaaggacgtggtggagcttgtcaaagagcgcggatgtacggcgaaggttgtcatcggaggtgcggcgatcacggaaagctttgcggaggagatcggagcagacggctattccaaggatgcggcggaatgtgtgaagctggtggatcgtctgttggaggaagagtagaaggcgaaaagcggtcttttccgccttcaaactgccccgggaaaatagatgcaaaaaaatagaaaaaaagtgttgactttttgcaatacggatagtatactaatcaagtcggttgcggtagcgaccgatgaatatgggatcttagctcagctgggagagcatctgccttacaagcagagggtcataggttcgagccctataggtcccatagatatcaatataatatggcggaatagctcagttggctagagcacacggttcatacccgtggtgtcgagagttcaaatctcccttccgctactagagagtcctcgggaatacaagcagttgtgtgtccggggatttttgttctttcataggaaaaggcttgaaagtgagggtatcatgagagtaggaatgggttacgacgtgcataaactggttgagggcagagatctgatcatcggcggtgtcaagatcccgcatacgcttggtctgctcggacattcggatgcggatgtgctgcttcatgcgattatggatgcgcttttgggcgcggcgggattaggcgacattggaaagcattttccggacactgatccgcagtataagggaatttccagtatgaagctgctctcccatgtggcggagctgatccgggagaggggttacgtggtggagaacattgatgcgacgatcattgcgcagaagccgaagatgcgcccgcatatcccgcagatggaggaaaacatcgcgggagcgctcggcatcagtacggatcaggtcaatgtcaaggcgaccacggaggagggacttggcttcaccggaacggaggaagggatttcctcacaggcgatctgcgcgctttccagtttttatgagggaagttttactgtggcggactctgcggcaggctgcgcgggctgcggcggctgcggacgaagcgtacaatgagctaagaagaattcaggcggctgcagacgaaacatgcagtgaaaaaagattgacaaaaacacaggaagtgcataaactatagtaggcaggagaggtatcttctgccgataaaaagatgaattggaaaagcgaagatcggaaagagtaaggattcggacattcgtcagagagagactgtcaccggctgaaagcagtcttggaagagagagtccccaagtgcctccgtgagctgatccggcgagagtcatctgcaccgcaggatgtagggatgccgtagccgggtacgtctggcatacgttacatgcgtcaagtgaaatcatatgattttagtagagtggaaccgcggatcatttcgtctctaggagacggatgatccttttttttgtaataggaaactttgttctggtttgtatgtggaaaggaatgggaagagatgggtatcctaaggtatatgaaggaagagtttcaggtaatcaaggaacgcgatccggcgatcaaaagtccgatggaagttttgctttatccgacatttcatgttatgctaagctacagaagggcgcataagctttatctcaaagggcattatttctgggcgcggtttatttcgcagcgcgcagccaggaaaacaggcattgagatccatccgggagcgacgatcggcaagggattttttatcgatcacggaagcggcgtcatcatcggcgagacgtcgatcatcggagataacgtgacgctgtatcagggcgtgacacttggcggtaccggcaaggagaccggaaagcgtcatccgacgatcgggaacaatgtcatgatcagtgccggggcgaagattatcggttcttttacggtcggggataattccaagatcggcgccggaagcgtcgtcatcgaggaagtgccgccgaactgcaccgtggtcggagtgccgggacgcgttgtaaagcgcgacaatatcaggacaccgcaggatgacatggatcaggtgcatcttccggaccctgtgaaggaggatatcaccgtgctgcagcatgagaatgccgaactggtgaaccgtgtgctggatctggaaaaagaagtgcgtattttaagcacgggagccggagcgtcacaggaataataagaataaaaagaaacggagaataccaaagtggagaataagttcaaattttacaatacactgacaagaaatatcgatacggtgattccgcatgaggatggaaagattgccatgtatacctgtggaccgacggtatatcattacgcgcatatcggcaatctgcgcagctacatcatggaggacgtgctggaaaaagcactgcgttatgtgggctacgatgtaaagcgtgtcatgaatatcacggacgtgggacacctttcctccgatgcggataccggtgaggataagatgttaaaaggtgcgaagcgcgagcacaagacggtgatggagattgcgaagttttacacggacgcgtttttcgatgactgcaaaaagttaaatatcaagcgtccggacgttgtggagccggcaaccaactgcatcccggagtttattcacatgatcgaggtgctgctggagaagggctacgcttatgtggcaggcggaaatgtctattttgacacttccaggctggacgactattatgttttttcttcccagagcgagaaagaactgttagtcggtgtgcgcgacgatgtggaggaggacgtcaataagcggaacaaaaatgatttcgttctgtggtttacaaagtccaaattcgaggatcaggcgctcaaatgggatagtccgtggggcgtgggatacccgggatggcatatcgagtgctcctgcatcagcatcaagcatctgggtgaatatatggatatccactgcggcggcgtggacaatatttttccgcatcacaccaacgagatcgcacagtccgagagctatctgggacacaagtggtgcggttactggtttcatgtgaaccacctgaacgacaagtcgggcaagatgagcaagtcgaagggggatttccttacggtgtcgcttctgcaggaaaaaggatacgatccgatcgtgtaccgtatgttctgcctgcagtcccactacagaaagccgcttgagttttcctacgaggtgctggacaacatgagcgttgcctacaagaagcttgtgaagagaatcgcggatctgaaggcggacggcacagtggatgagggtaaatttgcagagtacaaggaaaaattctgtgatgccatttccaatgacctgaacacttccatggcgattacaatcgtctatgacctgctcaaggatgataccttaaacgatgcaaccaagcgtgcgctggcggaggattttgacggcgtgctctccttgaacctgacgacggcgaaggtggagaatccggcggaagacacagaggtggatgcagagcttgaggcatatattttagagaagattgaggagcgcaaagctgccaagaaagagaaggattttgcaaaggcggacgcgatccgggatgatcttctggcaaaaggaattgtgttaaaggacacacgcgagggtgtgatctggcataaagcgtgagtcggagaggaagctggtatgggaagaggaatcgattcttatattaaggaacagttcgggattgcggaagtcgatatccgcacctactcaccgctgacactggcttatatcggtgacgggatctatgatctcgtcatccgttctgttgtcgtgggaaaagggaataccagagcgggagaactgcacaaacggaccagccagattgtcaaggcgcacacgcaggccgagatgatggaggtgcttctgccgcttctgacagaggaggaagcggacatttaccggcgcggcagaaatgccaagtcgccgacgatggcaaagaatgcgacgatgtccgactaccgcaaggccaccgggtttgagacgctgatgggatggctgtacttgcaggatgagtttgagcgtctggtggaactggtgaagaccggtgtggacgggctgcatttgaagttatagaacgtctgccgcgggaagaggaatcagagggcgaaagcatagagcgtctgccggtggcagaggatgctgcaggcagcagaaagcgcctgccggaagcagaaagaaaaggagaatacatgggatacgaggaattaaaaatagagggacgcaatgcggtgcttgaggcgtttcgttccggcaagacaatcgacaagctttttgtgctggacggatgtcaggacggaccggtgcgcacgatcgtaagagaagcaaaaaagcacgataccattatccattttgtggaaaaagagcgtctggatcagctctcggagacgaagaagcaccagggcgtgatcgcggtggcggcagcatatgaatatgcggaagtggatgacattctggagatcgcaagagaaaagggagagccgccgttcctttttctgctggataatattgaggacccgcacaatctcggggcgatcatccgtaccgcgaatctctgcggagcacacggggtcattattccaaagcgcagggcggtgggactgaccgcgactgtggcaaagacgtccgccggcgcgctgaactatacgccggttgccaaggtgacgaatctcacggcgacgatcaaggagttaaaggagcagggcatctggtttgtctgcgcggatatgggcggcacgcagatgtatgacctggatctgaagggaccgatcggtcttgtaatcggaagcgagggtgagggtgtcagcaagctggtgcgcgaaaactgtgattatgtggcttccattccgatgaagggtgacattgattctctgaatgcttccgtagcagccggtgtgcttgcctatgagatcgtcagacagcggatgatgtaagatgacagagcaggcataggcggacagatttttatgctgcggaaaatacagccgtgcgcggaacgtttgggcggcatagcagggcagagagggaagacggaggaagacgtggacgaatatcagaagctggcggatgaagaactcatccagaaactgcgcgaaggcgacgagcggatcatggattatatcctggaaaagtacaagccgttggtgcttcgcaaggcaaatgcgatgtttttgattggcggagatacggatgacctgattcaggaggggatgatcggactgtttaaggcaatccgggattaccggtccgacagggagacatcctttttccattttgcggaattgtgcatcaacagacagctctacagtgcggtggaggcatccaaccggaaaaaacatgtacctctgaatacttacgtgtccttttattcccagaccacggaggaagggaaatctctggcggagacgcttctcaccgaccagatggacgatccggaacagctggtgattgagcaggagaattttaccgctttctgggagcagctgcgggaacagttaagcgcgctcgagcgccaggttttagacgcatatctggaaggaaaaaattaccgccagatagcggaggaactcggaaaaagtcccaagacaatcgacaatgcgctctcgcgtatcaagggaaagatccggcagagatagagggaaggcaaaaaatggcattttgcaaaaaagagcgggaaatgaacaaccggttgtgcaaaattttgcggaaataaaaatactagtcctaaggtactgtacaaaatgtatagaaatggaacagaagttttgtgaagtttgtgcacacttctttgcgcagtcatggtactataataaccgtaaaaaccccccaatacattatatatagtttttgctataccccatagtaaaaataccttctcctaaaagggcagccagtgatggctgttctttttttgttatggaaaagagcagttctgaggaaagggagattgacagaagcatagaattgagataaggtgttagaggaaaaagaatatatcgcagagggactgtgcgcatgcgtaaacggttgagaaggttaaaacctgactcttggaacctgtcagttaatactgtcgtagggagcgaatgatggatcagatagtttgtggaatccggcgtcactgcgacgccggattttttcgtacaccctctgcagaaatggagcagaaaaatatggaacagtatgcaacacagatggaagcagcacgcaagggaattgtgacagaggagttaaagaaggttgcggcgaaggagcgcatgaccacagaggagctgatgccgctcgttgcggagggaaaggtggtcatctgcgcgaacaggcatcacaaatgcattgacccggagggtgtcggctcgatgctgcggacgaagatcaatgtaaatctcggaatctccagagactgtaaggattatgacgtggagatggaaaaagtgatggcggcagttgacatgggagcgcatgcgatcatggatctctcctcgcacgggaacaccattccgtttcggagaaaactgacggcggaatgtccggctatgatcggaaccgtgccggtatatgattctgtaattcactatcagagggatcttgcgacactgaccgcaaaggattttattgatgtggtacgcctgcatgccgaggatggcgtggattttgtgacgctgcactgcggaatcacgcgcaagacgatcgagcagatcaggaagcacaagagaaaaatgaatattgtatccagaggcggttcgctggtgtttgcgtggatgtgtatgaccggagaggagaatccgttttacgagtattacgatgagattcttgagatctgccgggagcatgatgtgacgatctctctgggcgatgcctgcagaccgggctgtctggcggatgcgtccgatgtgtgtcagattgaggaactggtgcggctgggcgagcttacaaagcgcgcctgggcaagagatgtgcaggtcatggtagagggaccggggcacatgccgatggatcagattgcagcgaatatgaagattcagcagacgatctgcatgggagcaccgttttatgtactgggaccgcttgtaacggacattgccccggggtacgaccatatcacttccgcgatcggaggagcgatcgccgcgcagaatggagctgcatttttgtgctatgtgacaccggcggagcatctggcgcttccgaatgtggaggatgtcaagcagggtatcattgcatcgaaaattgcggcgcatgcggcagacattgccaagggcgtgcggggtgcaagagagattgacgacaagatggcagacgcacgccgtgtgctggactgggatgcacagtgggaatgtgcgattgatcccgagaccgcaaaacaaatccgcgaggaccgcaaaccggagcacgaggacacctgttccatgtgcggaaaattctgtgcggtgcgcagcatgaacaaggcgcttgcgggtgagtacatcgatattttataaaacagaacacgggaaagtgaagaagcgtcagcggaaaaacaacattgcagtataaaagcggaatgtggtataataaaaaaggattctgtcagcaggagaatgaatgggaaaaatttatttggttgacagtgagaatgtaggagatatatgggtgccgcttctggtatcctcgcaggaagatgacgaggttcttgtattttatacgacaaagagcccgcatatgaattacgaaaatgtgaggatgctcaaggagacggaaaaggaagcagactttattaagtgttttgagggaagcaatgcgctggatttccagctggtatcggaacttggctatcgcctgagccagaacgcggacagggagtatgttattgtatcaaatgatacgggatttgacgctgcggtgcgctactggtcaacacggaaaatgcctgtgagccgtttaagcggaaaggaatgccacagaatgctgacagagaaaaagcagcgcgtggcaaaggaatccggggcagcagtagagccggaacaggaacagaccagagcggctggcccggaagtggaagcagagcaggttcgggagactgaacaggaagcggaagcagagcaggttcgggagactggacaggaagcggaagcagagcaggttcgggagactggacaggaagcggaagcagagcgtggcagagagcagtcaaagaagccacggtcatccaagaagtcagaaccgtcgaaagccggcggtaaggcaggagaatccgggaagccggaagcgtccgggaaggctggaaatgcagagacatccgggaaggcagaagtgatcgggaaagctgaggatgcagagaaatccgggaaggctgaaccgacagaaaaagctgggttggcaggagaatccgggaagccggaagtgatcgggaaggctgaggatgcagagacatccgggaaggctgaagtgaccggaaaggctgaggatgcggagacatccgggaagccggaagtgaccgggaaggctgaggatgcagagacatccgagaagtcggaatcggcagaaaaagctgggttggcagagaaatccgggaaggctgagccggcagagaagactggcagggcaaaacggtcaagaaagtcagcgaaagcagtcaaagcagaaaagtctgagcgtatgtcagaaccggatcgttcggaaaagtcacagaagagtgacaaagcaaagacgcagaacgcagggaatgagaagccggatctgacggaggaacaatccggacagatgacagaaatgatggatttgaaagaagaaatgtcagagaatccacagagtgtgtcaaatgccacggaccagagtgaagcgccagtgaagtttggactggatctgaatgcagagagagcaattttaaagacattgtgtgcctgcatcagcaaggaaaatctggtggattttcacaatgcgctggttgcgcttctcggcgaggaagaaggcaagcggctgtatcaggaactgaagacgaatgcagagtatgcgtcttactggtcagaacttccggcttatggcttaaaagaaaagtttgacatgtactgcaaaatggtttttgaccacagtgaatatgcaaaggaaccgccggaagatttttcgggattcctctatcaggcaaacggaaagcgaaagaatctcaattctctccgcgcagcattgcaggggcactatggcaaagacaagggaatgaaatattattccctgttcaagtcacacattaagatgatgaatcgcatgtagtaaaggagaagttgacagaatctgggtattcaacaggaatacgcaaaacgcctcaccggatggtgaggcgttttgtacgtttatcattttataaaaagaaggagaagcaggtaagatgtgggggacttaccggccatattatgaaaaagaaattgtgtcaatggggatttcctcttgacaatgattaagataccggataaatgtgaaaaaggtatgaagcagtgttgaaaaatgtgtgaagaatcgtcaaacaaattggaatccggggctgatagaagggaaaggcgaagttccagagcagaaaaagtgcgtgccagacccggaaagaatggaaaaaggttgacataatgccagaagggaagagcaacccgggtctgagacgagaaaaagtgcgaaccagacccgcatagaagcaaaaattgggtcccagaatagaaaaagtatcgctgagacccgcaggacgagaaaagtttttctacttcccccttggacacgagatagcattaacgcctcaaccgtatattccccctcatccagacttccatcacaatacatttgtcataataccgtaacactgtaacaccatagcacaaaaaagcgcaaaccctttcattcaaggatttgcgcttcttctcaatgaagctgctgacgggaatcggacccgtgacctccgcactaccaatgcgacgctctaccgactgagccacagcagcatctgtgtgagttgcctcagcacttgtactactatacactacgaagtggcagttgtcaagataataattctaaataattctttagaaatttttcgggtatttctgcggggaattttgcggcagatcaggtaaaatgtaatcaatgcacggggaggcgtgtgattctgcggcggatgtgttatgatagcagaaaagagaacaagagcaggagcggaaaaatggaacaatataacattttaattgttgaggatgataaagaaatcagggacggaattgaaatctttttaaagagtcagaattacaacgtattcaaggcggcagacggcgtggaaggacttgaggtgatggagcgggagaagatctcgctggcgatcgtcgacatcatgatgccgcgcatggacggcgttacaatgaccatgaagctgcgggaaaaatatgactttccggtcattatgctctcggcgaagtcagaggagaccgacaaggtgatcgggttaaatatcggggcggatgattatgtgaccaagccgtttacaccgttggaactgatggcgcgcgtcaattcccagctccgccggtatacgcagtttgcaaacaggagtccgaaggaggaaaagaatgatcggattcatgtgatcggaggactggaactgaatgaggacaccgtggaggtgtttgtggatggaaaaccggtgaagatgacgccgattgagttcaagatacttgcgctcttaatccggacaccggggcgtgtatattcggcggacgagatctatgagcgcgtgtggaatgaaaaggcgatcaataccgatacgattatggtgcatgtgagaaatatccgggacaagattgagatcaacccgaaagatccaaaatacttaaaggtggtgtggggtgttggatataaaattgaaaaacaacaatagaaacaacggtgccggcaataacaatgtcagcgcaaataacgatgccagcagcaacagtggtgccagcagaaataatggtgccggcaacagcagcaacaacagcaatgccgtaaacagcagcaagcggattatcatagcgatcgcgggaatcattttcatcacgatcattaccatgtgttttttcccggtggtgtaccggacggctgagagacagaaagagcagcagaaagcggagatgatgcgcgagtcctcggacagcgtggacaacgatacggtacagacactctatcagggcagctatgtcctgtatgtagaacagatggagcggagcgggcaggcagatgcaggcggactgtttttgaatctgccgacggatgatgaagattaccagtatgtaaaggacacggtaacctctacgtttgacgaatggaaaagccagtttgagagtgacagctggaacatcgattactgtgtatacaaaagcagtgccgactgcgtgaaaaatacggatcagccgctcgagacatgcgtggatggaactgtgacggagaagataaagcagtattatacggacatcgtatgcttatcctttgacaaagagggcgcgctggaagtgacaccgctgtacgacgaaaatatcagcggcagcgttctgatcaaggcgtttcagaatgtagaccgggaaaatcttttgggacagtcgctgggcggatatgtggaagcagggcagctgcagggaccgaaggactttaaggtgatcttcgggcttccggtatcaacgagtgatacgatttccttgggagatccgtatgaggatatgacaaattactgggtgcaggtggtgttagtgtaccgtgcgtccggcggaagcattctgtttctggtaagccttgctgcggtggcgggatggatgtttcttatgacgagcaggcgcatctggaacgaagacataccaatgcaacgcccggggaaatggtatctcatggaggtggcggtgattgccgtctgctgcatggcatgtatggaggaaaacttctacgatatcataagaagctattcctattatagcgaaggagtggatgttttacttggaaacaatgcctggagagccatcttacagcttggacagatgatggtcccgctcctgtttttgtatggcatctggtacgcggcgcttcgcgtactgcgtccggtatttttcctgggagtcagggaatatatcagacagtacagcctgatttatcagatttttccgtggttgaaaaaattgtggaacacgttccgctatgaggtggcgcatgtggatttttcagaaaaatccacaaagacgatctggaaaatcgtgctgatcaactttgcggtgctgtcgctctgctcgatgatgtggtttttcggcatcggcgcgctgatcgtgtactccatctttgtgttctgttttatcaaaaaatattatgacaggatcggcagagattatcaggcgctgctgcgcagtgtaagccggatggcggacggagatctggacacggagatcaccgaggatctgggaatatatgagccgatgaaggtggagctttccagggtgcgcgacggatttaagaaggcggtggatgaggaagtgaagagccagcgaatgaaaacggatctcatcacgaacgtttcccatgatttaaaaacaccgctcacggcgatcacaacctacgtggaactgttaaagaaggaggacatcacggaggaggagcgcaggtcatacattgagacgctcgataaaaagagccagcggttaaaaatattgatcgaggatctttttgaggtcagcaaggcgaccagcaacaatattgtgctgcatccgatggaagtcgatgtggtgaatctgttaaagcaggttgcggtggagcatacggagcgctttgcggcgatggggcttgtgctgcgatgggatgtgccggaggaaaaagtgatcgtggtgcttgacaatcagaagacattccgcatctttgaaaatctgtttgtcaatatccagaaatatgcgatgccgcagagccgtgtgtacgtgcaggtacaggaatacgggatggcaccggaggagttcgtggagattacgatcaaaaatatgtcggcaacggaactgaattttgatccggaggagatcacggagcgcttcgtgcgcggcgatacctcacgcggtactgagggctcaggattggggcttgccatcgccagaagttttaccgaggcgcagggcggaaaactgacgatcgaggtggacggtgacttattcaaggttgtaatcagactgaaatgtggtacactacaggtagaaaaagagatggaggtttaagacacatggaatcaatggatgattacaaggaggagttagaagcttctttccgcagaatcagagagggagatattttaaccggcacggtgatcgatgtcaacgaggagggcgttacgcttgacctgaaatattatgcaccgggatttatcagtgcggaggagatgagcagcgatccggatttctcactggcggaggctgtgcatgtgggggatacgatcgaggcgaccgtgatccgggtagacgacggcgcaggcaacattcttctctcacgcagggaagccaatgaagagcaggcatgggagaagctcaaagagatgatggaggagggtacaacggtaaccgtccgcatcaaggagagcgtgaaggcaggcgttgtggcatatcttgaggggatccgcgcgttcattccggcatcccagatcacatccgcttatgtggaggatacggagagctgggtaggaaaagagattccggtccgggtcatcacggtggatgaggagcgcgaaaagctcgtgctttccggaaaggcggtcgcactcgaggcagaggcggaggagcgcaatcacaagatctctatgatcgtgccgggaaccgtgcttgagggaactgtcgagagcctgatgccgtacggcgcatttattgatctgggcaacggactgagcggactggtacacatctcacagatctgtgagcgcagaatcggaaagccgtccgaagtgcttaaggtcggagagaaagtcaaggcaaaggtattgaataccaacgacaataagatcagcctgtccatgaaggcgctggcagaggagatggtagataccgaaggcgtggaagatctggaggcatatacagaccacacatccacaggaaccagccttggctcgcttctggcaggattgaagttagactgatcaaactatttgagaatctttctctaatagaaaactgattccgttgcttttgcaaccgaaacggctcttgcaatgtgatacatttagttagaatattctaactatgcgtaagaggcaatttcggaggaaagcaatgagaaaagcaggacttggaatcgacatcggaaatggaagtatttccatcgttgttgtcgaaggcgaaaacatcatatataaagattacagactgcatcgcggagaactgtatcagaatcttgtggacatgcttgggcaggtggagacatcgtgcggcgacaggattttgtatgcagcggtcaatcccggtgcagtctgtttgtatccggggatccaaaagaaagtgcagatcaaccgcatcagcagccttctggaaggacagagaatgctctatccggacgcgggaagcatcgtagagatgggagcacagaattcctgcttccttaccggaatccgtgagagagagacgctctcctacgccatgaacggggaatgtgccgccggaacgggagcatttttcgaggatcagatgtaccggctcggacttccgctgtccgcctactcggagtatgtcagacgggcgaaaagtgtgccgcggcttgcgggacggtgcagcgtgttcgccaagacagacctgatccacagacagcaggaaggtgtgccggtggaagatattctgctcggactttcctatgccgtgatccgtaattttaaatctgcggtcgtgcggaagcttccggtacagccgccggtgcttgtgacgggaggcgttgtctataatgaaggcgtgcgcctcgccatctgtgatatcttcggattaaacgaggaagaactactttgcggggaagagggagctgtggtgtctgctgccggaatcgcagcctgtgcatgtcacgggaagctggccttcgactggaaacacccggtccgcagggaggtggcggatgaggagcaaaaaagaaaggcgctgccgcgatatgactacgagaaggaggcacttcaccggaccagaccgttacatggcggggaaaagctctggctcgggattgacgtgggatccacgagcacaaaccttgtgctgacgggggaggacggagccgtcattgacgatctgtatcttagaacgcgcggcaatcctctcggcgcggtgcagcagggaatggcacagttaaagcagaaatacggggaagcactcacgtgggaaggcattggtgtcacgggatcggggcggtactatatcgcggagaagaccggtgcaggcacggtgttggatgagatcacggcgcaggcgcgcgcggctgcccatctgtgcccggaggtggataccgtgtttgagatcggcggtcaggactccaaatacatcagtatccgggacggccaggttgtcgatttcgagatgaacaaagtgtgtgcggcgggcacgggctccttcgtcgaggaacaggcgaaccgcatggaagtatcgctggaggagatcggaaacagtgccttgaaggcaaatgtgccgatcgatctgggagagcgctgcaccgtgttgatggaatccaagattgcagcggagcttgcggcaggcacggacaaggaggatatctgtgcagggctgtgccgctcgattgtcagaaactatttaaacagggtagtcggcaataagcgcaagggagaacatatctgccttcagggcggagtcgtgcataacgagggaatcgttgcggctttctatgaagtgtttggagaacggcttcacatcacgccgttttacgatgtgaccggggcatacggagcggcgctcgcggcaaaagagcagggcggtacatcccaaaaggagagcatccggaacgaggagaattaccggaagagccagaaatggttcctggcaggctatgacggaacgctgctgccggggaaaaagactgtgggaatcccgcgtgcgctcatgatttataaatttttcccgatggcgtaccagtattttaagactctcggatttaatgtattgctgtcgccggagacggacgataagatcattgcgctcggacaggagatggcggcggaggagacctgttatccggtaaaattactgcacgggcacatggaatggcttgcgagaaaaaaggtggactacatttttatcccgtgtatccatacgatccggcatgagacttccggcgttgcgcacaattacggctgtgtctatatgcagacagcgccgcggattgtcgcaagtgtgctggggctttcggagcgcggcgtggagctgatctgcccggttctggatctggatatgggaaaaccgcagcttgcgggagcgatgatcaaagcgggtcaggaactgggatgcgacaaggcacggtgtgcggcggcgctcgcgaagggcgcggcggcgatggtgcgctgtgagaagaattctgaaaaactgggcgcgcagatcctggacgagttgaaaccggaggacaaggtgctcgttctgattacaagaaactacggcgtgtcagacccggttttaaatatgggaattcccggggaactgttaaagagagggtgcagagtgttgacactttcccatctgaaaggacatgatgtggatttgtccggtcattatccaaatttgtactggccatttgcgcagcacattctgtcgggagcgaagatcattaaggagcatccgaatctgtatgccgtctatctgacgaaccacggctgcggaccggacggcatgatctcccacctttttgcggaaattatgggggacaagccgtacctgaaaatagaggtggacgagcatcagtccaaggtgggagtgataacgagaatcgaggcgtttttaaacagcttatcccatgtagagaactgcacggagcgcgccatactgccggaggcagccgtattgtccgagcggcttcgggacgggaagaaaggcatgaaagagacgaaagaaccgcagcaggagacggtgtatctgccgccgctgtccgtgtatacagagtggatggcactttacctgaatcagaaaggaaaacgcacggcagtactgccggattacacggcgcaggatcttcatgcgggaaaagcgtacagcaccgcaaaagaatactgtacattctcggctgcggcaggacagattgcaaaccggctgcaggagacggacggggaggaaaaacagtttctggtattccagaccgagggtgcggaggcggacggaatggttccggaaatcctgcgtgcggtcttagatgcggacggaaagagggcgcatcttgtgacaccgtttctggaacagctgctttttgcggaagaagcggatatcttgtggcaggtgctcttactcggggatgcatggcactgcctagatgaggagtggcgggaaaaggtgcgtgcctctttccgggagaagaccgccgcgccggatgcctggagcagggagtggaccaaaagccttttacaggagtgggcggtatatgtgacggaggacagacagctgctgctggccggcgatccgattgtgctgcatagcgcttatctgaatcagaatatggaggaagcggtgaggaaacatgcttttgttccggtgtatatgccgctctcggaatatctgtggttccttgctgcggagtcggggcgaaagattccggagcattttacagaacagctgcatgaatttatgcagatttaccgcggcgtttacggcagctggaagcagccggacgaacgcttacaggagatccgggagaagtttccgctggttcacggagcaaacctccgctatctgtgcagcctgatggagcaggaactgccgcgtggaaaaggaatgattctggtgtcaccggaatatgccaactatgcgtcggtgatggagatgctgcgcacggggtcaaaatatccgctgctgcacgccagggcggacggaaatgaggaagcggaagaagtggagcggagagaaatctttctggggctgctggaataataaaggagacaaaaaggaattgccgcaataagaatatcgttctttggattggtaagtaatattatcagaaaaccacaccgtgggatttcagatgaaaatgcagatggaaattcggttcaaaaaatgtggcatttctaaccagccgaatgtttgcatcttcgatgatccgtgtctttccaagtttggagcactccgcgggtcatgtccgcatcccggaagacaatttataggacttttgtgtgtgtcccttatggcacctctgaacaaaacataaccgcgcgaagccgctgtttgagtcggcatctgccctatttttaatagcagatgccgacgagttcggttcgcgcggttttatattgtctgtgaagaggcgccattagggacaccagaaagtccgcccattgtctccggtgtgtcggacatgcacccgccggattgtccaaacgtggaagagacacggaatccgatgcaaacattcagccggaagaaatgctcgcatttttttccaacgaatattctatctgcatttccacatgaaatcccgaagagtgtttctgataatattacttatcactcccaagagatctatgcttatcgcggcaattccttttttaatcgaggcttacagcagctggattccgctcttttcgcatgcctgcatcatctcatccggccacagggaggactgcacctcgccgatgtgcgccttgcgcaggaaaaacatacagatacgggactgaccgataccgccgccgatggtgtaaggaagctcgccgtcgatgatcgccttctggaacggaagcttcgcgcggtcttcacagcctgcctttttaagctgggacagcagggcttttttgtccacgcggattcccatggaagaaagctcaagggcaatgtcaagtaccggatagtatacaagaatgtctgcgtttaacgcccagtcgtcgtaatccggcgcgcgtccgtcgtgcggttcgccgttttccagcgtatcgccgatctttaagatgcacacggcgcctttggtcttggtgatatagtattcgcgctccttcggcgtgttgtccgggaacatctccgcaagctcttccgtcgtgacgaaaaagatgtcgtgcggcaggatctcctcgatgtaatcgtactggatcgccatgtatttttcggtcttgcgcaggcatttgtatacggtgttcaccgtttcctttaaggtgtcgagcgtgcgctcctcctgcttgatgactttctcccaatcccactgatccacgaagatggagtggatattgtcggtgatctcatcgcgccggatggcgttcatgtcggtgtaaagaccttccccgtaagaaaagccgtattttttgagcgcgtagcgcttccatttggcaagtgactgaacaacctccgcggttctgccgttctgctccttgatgtcgaaggtgaccgggcgctccacaccgtttaagttgtcgttgagaccggacagcgggtctacaaacagaggggcggatacacgggacagattcaggcgcagtgcaagcagtccctggaaaaagtccttgaccgtcttgatcgcaatctgtgtatcatgcaaattcaattctgaatgataatcttttggaatgattaaattgtccatctggggttctcctctcttgtgtacgcaaaagcgtagacattaacctaaataattatagcacagggcagttcattttcaagaaaagatacaggtatttgaaaaataatacgtgtatacaatttgagacgaaagggcgctcggaaatggtataaacatgcgacttcagggcgggaatccgtcgatagatgttgacagtaatatgcaaaaatgagaaaatattgacaagattattatgcaattatcatagaatctggggtatcacaagagaaaaggagttgaggcacatgcaaaaggaaaaaggaatcgtatcgattaaggttaagcttttaggtgtgatcgttccggttgtcattgtcagcattctggtgctcgtactgatcgcctaccgcacgtcggcagggctgattgagagctattccgagaatctgctggagtcatcggtggagaatcaggcgtcgcagattgagagctggctggaacagaatatcggggcgttccagatagtgaagacaacgatagagaacacgaagccggacgacaaggaattacagaccatgctggattcctactataattataactcaaattatccggagggactttacatcgcggatgagaccggaaagctctggaaagcgtcggattcggcgatgagtgagtcggatccggtcaacagtgtctggtatcaggagggactgaccagagtcaatatggcgatcggatcttcctatgttaattcagaaggcgtcagtgtcatcagtgcatccggtattttaaatgacggcagcggcaagatgaaagtcatctctgcggatatgacgctcgaccgcatttccgtcattgtaaatgcgtttatcgagatgaagaatgcggaggctatcctcgtggacaaggatacggcaacgattctggcaagccgtgattcagcgaagatttccacgacgctcggcagcgacggcagcagtgcattcgagcagagtgtagcggcgaagattgcggatcgtgattacagcttttccacattggacggcaatatgaccgtgttcaaggaggtatccggaactaactggattctggtttcctatattccgaccagcattgtactggcagaccttgcgaacctcaggaatctgatgattctgatcagtgtgatctccattctgattctgtgtgtagtgattgagcgcacaacgcatgttgtgatcgcacctgtccggaagctgacgaacgtcatcaaggcgctgacggacggcgactttaccgtatcggtcaagagcagcggcaatgatgagattgcgcttatgagccgcagcgtggagcgctttatcgcatccatgaagcagatgattgcgtccatgggagacatttccggaaaactgggaacgcaggcggatgcgagcgacagtgtgtccagagagatgcagtcggcggcaaatgtccagtcccagtccatgagtgagctgaatatgacggtggatcagctgtccgtttccgtcaatgagattgcagacaacgcgaccaagcttgccggtgtggttgcagacacgaaggacgacagcgtgaatgtcggcaacaagatgcgcgagactgttgaggtatcccagaagggacgcgaggatatggagcatgtcggcgaggcgcttgagaatatccgcacctctatccagaatctggaagcggcggtaaataaagtgggtacggcatccggtgagattgttgagattgtacagctgatcggaaatattgcggaggagaccaacctcctgtccttaaacgcttccattgaggcagcgagagcgggcgaggcaggaagaggattcgcagtcgtcgcttctgagatcggaacgcttgcaagcaacagtaccgcatcggtagagcatatttcaaagctcatccatgaggtcaatgaacttgtggcggatgcagtgcgtcaggcaggcgacagcgccgacaatatcaatgagagcagtggattgattcatacggcaattgatacctttgataggatttatgacaacattcagcagacaagcgctctgatcgaccagatggttgacaagatcaatcaggtagatgaagtggcgaccaacgtggcggcaatttcggaggagcaggcggcaagctcagatgagattcttgcaacatcagagtccatgctgacgcaggcaaagggaattgcagagaacagtgagaacgtggcaaaagaatccagaagcctgacagagtcatccatacagctggcagatcaggttaagctgtttcgcatttaaggggggtatcagatatgaagagattgatgagtgcagcactcgtggctgcgctgggagtgacgtgcctcggaggctgccaggcgggcagcacaggaggagataccgcggtgaatggcaagggagtgaagatctatgtatcactgtcacaggcagatgcgttccgtaatacattgatcgatgcggcaaagaagacagcggaggcgagtggagcagagatcgtggtgtacgatgcggagaactccatcgagaaccaggtagcgcagattaaacaggcggttgcggaagattatgatgcgatcatgtgtggaccggtcgatgcggacactgcgctggaactggaagcgctggcgggagatattccgattgtattttacaacagctgtccggatgcatcggtgctggaaccggacaaatacatttatgtaggatcggatgagggagttgccggacaataccaggcagaatatattctggatcagatgagtgacaaggatgagatcaatgtggtactcttaaagggaccgaagaatcattccgcaaccaagggaagatccgaggagttcaaaaatacgcttaaggcatccggcaagaagatcaacgtcgtgtttgaggataacgcagactgggagcagggaattgcagaagattatttcgatctgttcctgcagacaggcaagcagtttgatgcggtggtatgcaacaatgataccatggcgcttggagtcatcgattcctgcaagaagaatggcatatcgggagtaccggttcttggaattgacgcgacagcagatggctgtgcggcaatccaggcgggggatatggcatttaccgtataccagtcgggaagcggacagggtgaggcggctgtcaaggcggcaatcgcactcggttccggaggaacgacgcagggaatggaaggcctgtcggacgacggactttacgtctgggtaccgttcgagaaggtggacagttccaatgtggcagattatcagtaatagagagggaagagggcatcagtgcggtctgcactgatgccgttttggtgtaagagaatggaatatacgcatgtgacacatacgtttggacctgtttatgacgatgcatcccggattctgattctgggatcctttccgtctgtaaagtcgagagaacagcagttttattacggtcatccgcagaaccgtttctggaaagtgctggcagcggtctttgaggatacgctgccggagacgattccgcagaaaaaggcgtttttgttagagcaccatattgcgctgtgggatgtcattgcctcctgtgacattgcaggatcatcggacagttcgatccgcaatgtgacggcgaatgacatggaagtgatcttaaagacggcggacatccggcgcatctgtgccaacggggatacggcgtaccgcctgttttctaaatattgtctgaccgcggagatgccggaagtaaaaaagctgccgtctacgagtcctgccaatgccgcatggaatttagagcggctgacacagtgttgggcgcaggaacttttgctgtaagaaaaagagagggaaaaggaggtgtgagacatatgaaaaagaacgagatgacatggcaggtgatgctcattgaggcagtcggtatcgtatcggcgatcgcctatctcgggttacagatctattacgggatcgcgttccacgtcaatccggtgaacctgatgatgaatcttgtgtttatgattctggtatatgtgggtctgaccctccttgccgtctacccggaacgtgtgaacggattgacaagggaggtatgcagcggtaagatcagacagtatacgcttcggatggttcggatggtcaagcttgtctttgtggagggacttttattcaccagcgtctgtgatgcgctcgggaaagaattaaaacagggatacagcctgattatcgtggtattgattgcagcgattgcggtgtattatgagggaaggatcatacacattctgaagcagaataacaaaagatagaaaggcatctgcaatgacaaaggatatgacggaaggagcgataccgcctcttctggtaggttttacaattccacttgttctcggaaatctgtttcagcttttctacaatgcggtcgacagtatgattgtcggaaaatttgtgggggagacggcgcttgccgcggtcggtacgagcagtccgctgatgacgcttgcgattctgtttatcagtggcatgtgcatgggagcaggcgttctgatgggaatgcactacggcgcaaaggattatgatgtcctggagcggcagatcagttcgaccatgatcggcgggctgatgttttccgtcctgctttcagccgtctgcgtttttctgacgccgtggctgcttcggctgataaggacgcaggaggaagtgcttccgattgctacggggtacctccgcattattttctgcggactgatctttacgtttatttacaacttttatgcgagcacattgcgggcacttggcgacagcagatcgccgctttattttctgatgatcagcgctgcactcaatgtggcgggagacctgtttttcgtggtggtgctaggctggggcagcaacggatgtgccttttcgacggtgctaagcgaggcactctgctgtctgctgtgcgggctatatattaagaaaaaggtaaagattctctgcctggggcgcaagtggcgcgtgtttgaccggaggttattttataagacggtgcagtttggctgggtgagcgccatgcagcaggcgacggtacagctcggcaagatcggaatccaggcgattgtcaatacaatgggaatctctgtcatggcggcgtttgcagtcgtaaaccgcattgatgattttgcctacactccggagcagaatatcgcccatgcgatgaccgcgctgctggcacagaacaaaggtgccggcaaaaaggagcggatccgggagggattccgttgcgggctgtggatcgagatgatctatgcgctctttatctgtgtggtctgctttgtgtttgcgcgtccgctgatgaagctgtttgtgacggatgaggaggtgatctccctgggagtgatctatctgcatgcgattgcggtgatgtattttctgccggcggccacaaacgggattcagggatattttcgcggaatgggcgacctcaaggtgacgctcagcagcagttttatcaacatgggagtgcgggtggcggcagccattccgctggtattttccatgaaacttggaattgtggcactgccggttgcctacctgatcggatggctggcaatgctggcggcggagacaccattgcttttccgccggaaagagtgagcgggaggcggttgctttttcctgctttacaaagaaaaatgataatgatagaatacccataggtgttttttgttcggaagacacaaagggaggaagcgtttatggcaaacctgtttcagcttttactggcgcagattcaccccagacaaggaagacctgcaggagagccggaacgggcggagggatataagacacacccgaagcgcgagagcaataataaggttcgggagaccagggttttagagaccggggagagcacgcaggaacgggaaaggatacagacagaagtggaaaaggaagatttcttattaagtcagatcgacgagtttcgtgagaaggcgaaacagctgcaggatctgcttgcagcgaaggagaataaagtacaggaactgcagtcgattgtcaacgagcgggaaggcaaggccgaggagtggcagcacattctggtggagcgccaggaggaagctgacaagatcgtgacagagttcacgaagaaggtcgatgatctggcagaccgtgtgacagcgaagatgaccgagattgagacaagcatctcggggcaggttgcggaggtaaagcgtgcgagcgaggagcagcttgcatcgaaccgcaagctgaatgaggatcagattgctgcaaataaaaagctttccgaggagcagcttgcgacaaacaagcagtttttggaggagcaggcaatcgcgaacaagaagctttccgagggacagatcgccgaggtcaaggcgctgcttgagaatgcgacagcacagctggaatccatcaagacagatctctccgagaaggtacattcggagaacgtgaagtgctaccgcaacattcaggatctgttcaacgaatttgattccaagatcgaaaagatggacgagatggagcagggagtcggatcggtgaagggatatgtcaaatgtctttcctggtttgcaattctgaactttgttgttctgatcggattcatcctgtattctctcggtgtgtttaatttttagctttaaggaatagaagatcatatgagtacagaatcaaagaaagtgtgggtcgtggggcataagaatccggatacggattcgatatgcgccgcgatttcttatgcatatctgaaaaaccagagcggggacaagaagacttatgtggcaaagcgtgcgggcgcggtgaatgaggagacccgctacgtgttagagcgctttggcgtggaggaaccgccgcttgtgacctatgccggtgcacagatcaaggatatcaatatccgcaagacggccggtgtcagcaatcagatttcgctgaaacgggcatgggagctgatgaaaaagctggaggttgtaacgcttccggtcaccaatcagttcggcaagctggaaggtgtgatcgtcaccaaggatattgcgacgtcctacatggacgtgctggacaactgcgtgctctcaaaagcgcgcacacagtacaagacgattgcggagacgatcgacggtgaggtctacgccgggaatgagcatgcacattttgtgcgcggaaaagttgtgattgcaacctccaacccggaatacatggcggattatatcgaggatgacgatctggtgatcctaggcgaccgcgaggaggcgcagatgcaggcgatccggtcgaacgcgagctgcatcatcatcggcggaggtctcgaggtggcggaagaagtcaaaaagcttgcggagaagcgggactgcgtgattatcacaacgccgttcgacacattttccgtggcgcgtctgatcaatcagagtatgccgatcaagcagtacatgaccagacgggagctcgtcacgtttgacattgacgattatgtggacgacgtcaaggatgtcatgtcgcgggtgcgccacagagatttcccggtgctcggctcaaacggcaactacgtcggaatgatttccagacgtaacctcatgaatatgcagaaaaaacagatcattcttgtcgaccacaacgagaagtcacaggcggtggacggaatcggagaggcggagatcttagagatcatcgaccatcacagactgggaagcttagagaccgtatcgccggtttatttccggaatcagccgctcggctgtacctcgacaattatctatcagatgtatcaggaacagagggtggagattccgaaagagatcgcgggacttttgctctcggcgatcatttccgacacgctgatgtttcgctcaccgacctgcacgccgcttgacaagagcgttgcaaagcggctcgcagagattgcggatgtggatattgaggatcatgcgaagaaaatgttccgcgccggaagtgatttcaagaacaagacgaccgaagagattttctatcaggattttaagattttccacacggaagactgtgatttcggtgttgcccagatcagcgccatgagcggagaggaattagaacagatcggagaacagctccgcccgttcctgccgcaggtgctcggcgagaagcgtttaaatatggtatatgtcatgctgacggatattttggaggaatcttccaagattatatttgcgggggaggatgccggaaaaattctggcgcatgcgttcaagaagcaggaggatgcggatggcatcctgttggacggcattatctcacgtaagaaacagatgatacctacactcatgaatgagatgtcagagcgagtatagcccgctctgtgagcatagcccgctctgtgaacatagcccgctctgcgggcatggcttaaaggctttggcggtaatccctcggggattccccaaagctttttttgtatgctctcgagaaggtcgagtaattctgaaagccgcaggaatagcatacttccgtgatcggcgtgccggcggcgatcagctctttggcgagaaacagccgcttggtgagcagatagccgccgatggtgtagccggtctgcgccttgaacgtgtgcatcaggtaggagcggcttaagtaaaagcgggaggccaggtcatcgatcgagagatcctcggtcagatgagcgtttagataggtgagaatcgagagaatcttctcgttggaagcggagtctcccacgaattcaatgtggtggtgcagggcggcgcggttgagctgaatcataaattccaggaataaaagccggtggtgcagcgccgccgcatagtcgtcgtcgtttaaggaggcgtccagcgcgcggatggaggcgccgagcctgccgcccttggaatcctgcagacggaggatgtgtgcctgctcgcggtacgcctgcttaaagcagaaggagagatcgcagtcttccccggcgtactccgtaagaaaatccggggagacatataaaatgatgcgctcgtagggaagatccgagtggatctcgggtttgtgcacttccccggcattgaccaggacaatatcgcccggggcaagctggtaggtgcgcccctcaatacagtaggtcacgtcaccgccgagaagaatcaggatcttgtgaaaatcgtgatagtggtagtgaaactcccggcgggaagtatcttttaaatgaaacatcttaaagctggtggttaagtatccgacctttttgtattccggcatcgcgtgcgtcctcctttttctattactgtattataaaaaagcactttttgcaatataaaaagcactttgagactatatattataaaaagtgttttgtataatagttgtatatgaagaaacgcatgtccaaacagatggaggaaaataatatgaaaaatttcagtaattataccgattttgatacaaaggaaaatctgcactttgagtccaaggccgtgcacggcgcgctgggaacggaaccgctcaccggagcagtcagcatgccgatcttccaggcagcgacattccgccatccggagcttggcgagtcgaccggctttgcatatagccgtctcgagaatccgaccagacaggaattagagcgcacgatggcaattcttgagggcggaatcaagggattcgcattttccagcggacaggcggcaaacatggctgtcttttccctgttgaatccgggcgagcacgtcattttatcggatgatatttatggcggaaccttccgcattattggggacgtttttggaaaatacggtattgagcatacctatgtagacatgtcggatctggatgaggtgaaggcggcgatccggccgaatacgaagatgtttttcattgagacaccgacgaacccgatgatgaaggtggcggacatccacgcagtctctgagatcgcaaagagcgtgaatgcactcacggtggtggataacacgtttctgactccgtatttccagaagccgctcacgcttggcgcggatattgtcacacacagctccacaaaatatctgggaggacacaacgacaccatctctggcattgtggtaataaaagacaacgaggagatcgccgatcagatccatattcatatgaagtcccacggaagtcagctcgcgccgctggacagctggctggtgctgcgcggaatcaagacgctggcagtccgcatggatcgtcacaatgaaaatgcgatgaaggttgccgagtggctccgcacacagccgaaggtgaaaaaagtctactatgtcggctttgcggatcacaaggattatgaggtgacgagaaagcagaccacgggattcggcggtatgatttccttcaccgtggatagttttgagacagtgaagaagatcttaaagggcgtagacatgattatgttcgcggagagtctcggcggaacggagactctcatcacatatccgacgacacagacacatgaggacacgccggcagacatcaaggagaagctcggtatcaccgactgcttccttcgcatgtcagtgggaattgagaacgtagaggatatcattgccgatctggatcgcgcaatgaacggctgataaaggagattggtgagaagatgcgatttacaaagatgcaggcatttggcaatgactatgtgtatattgatgcgattcatcaggaattaaagaatctgccggagttggcgcggtttgtcagtgaccgtcattttgcaatcggttcggacggaatggtactgatctgtccgtccgagaaaggggacttccgtatgcggatgttcaacccggatggcacggagggggaaatgtgcggcaacgctctgcgcagcgtcggaaaatatgtatacgatcacaggttgacggacaagacagatcttgtgatcgagacacttggcggaatgcagcatctgaccctcaccgtgaccgacgggctggtatcgaatatccgcgcggacatcggtgagccgagactggtcactgcagtgattccggtagtcacggagctgcccgagttcgtggagcagccggtgcaggtgcttgaccggacattccatatcacggcggtatcctggggaaatccgcactgtgctatgtatgtggattctgtggcagatctggatgtggaaggctatggaaagacgattgaacatatgacatccatttttccgaataagacgaacgtgacgttcgtggaatttgtgcggaaggattatattaagatccgcgagtgggagagaggaaccggcgagacgatcggatgcgggacaggctgtgcgacggcggttgtggcaggcgtcctcaccggacggacagaccggaaagtgacggtcgagcagatcggcggaccgcttttcatcgagtgggatgagaagacgaatcatctgttcatgacgggaccttcccacacggtattcgagtcggaaatcgacgcgtcacacatcatcggataagaggcgcagataagcagcagtgcataagatgcgcgattgtggcgcaggaatggagataaaatgaagttaagtgaactttgcagtgaattcaaatacgagtgtctctcgggaagcatggatgtcgatgtgcgggatgtcatctatgattcccggaagattacagagggaacggtgtttgtctgcatggtgggagctgtgacggacggacataaatacatcccggatgcggtgaaaaagggtgcgtcggcgatcgttgtcgagcgtgccgatgaggcgcagcagattccggatcaaatcacggtcattcaagtggaatcagccagacgtgcgcttgcctacatgtcggcggcgttgttcggacatccggaccgtaagctggtcacgatcggcattacaggtacaaaaggaaagacgacgacgacttacatgatcaagagcgtgcttgagatggcggggaagaaggtcggactgatcggaacgatcggcgcgatgatcggtgatgagcacatcccatcgaaaaatacgacgccggagtcctatgaacttcaccggatgtttgcggctatggtggaagccggatgcgagtatgtggttatggaggtgtcctcgcagggattgaaactggaccgcacggcgggcatcttgtttgattacggcgtatttaccaacctttccccggatcacatcggaccggcggagcatgagtcgttcgaggagtatctgtactgcaagagtcttctgttccggcagtgccgtgtcggcatcgtcaatgcggatgatcctcactgggaggagattttaaagggacacacctgtcaggtgcgcacattttccgcagagggaaatgatgtgaaagaccaggtggtggatctgtttgcgtcggacatcggttatatcaacgagggcggcagactcggcatgcattttaccgtgagcggctgcatggactgcaaggtaaaagtgcatattccgggcaggttttctgtgtacaatgcgatggtgacgatgctggtgtgcaaccttgtcggtattccggaccgggcagtgctcgacggacttgagaaggttcaggtcaaagggcgtgtggagatccttccggtttcgaaggattattcgatgattatcgattatgcgcacaatgaggtgagcacgagaagcgttttgacgacactcttagagtaccatccgaagcgcctgatctgtgtctatggaggcggtggcaaccgctccaagttaagacgctacgatatgggcgaggtgaccggagaacttgcagatctgtgcgttctgacctgcgataatccgcgcgatgaggaaatccgcgacatcaatgccgacatcaaggtcggtctggcaaaaagcaacggaaaatacatcgagattgacgaccgcaaggaggcgatcgcctactgcatgacgcatgcaaagccgggggatatgatcgtgctgctcggcaaggggcatgaggattatcaggagatcaagggtgtaaaatatcattttgacgagcgcgaagccgtagcggaaatcctggacgagatcaagtcgggagagcgcacggtcgaagcgtagaataacatataagtatcggaccttttgcaataagtaatatgataggaagcattacatgcagatttctggtggaatgcctatgaaacattctgttcaaaaaatgcggcatttctaaccagccggtgactgcatctgtgatgatccgtgtctttccaagtttggagcactccacggagggtgtccgcaagccgcagacaattttaggacttttgtgcgtgtcccttattggcaccactgaacaaaacataaccgcgcgaagccgatgtctgaattggcatctgccatgttttcaatagcagatgccaacgagtttcggttcgcgcggttttatattgtctgtgaagtggtgccattagggacaccaggaagtccgctcattgtctgtggcttgccggacaccctccgggattgttcaaacgtggaagagacacggaatcagatgcagcccatccggctggaagaaatacacacatttttttcaacgaatgttccacatgcagttccacccgaaatcgcaggacatacttcctataatattacttagcgcgtattcttttcataaagcggttgacttccgagaagacagatgataatatagtattcatataagattactatgaaaaaagatctggagatagggtataaagggaggaactgatatgaagatttccacgaaaggacgctatgggatccgtgcgctgattgatctggcggtgaattccaccaatggtcatgtgtcgctggtaaatattgcaaacaggaatcagatttctgtgcactatctggagcatgtgttttccagcttaaagcgcggtggtattgttaagagcgtcaaaggcgcgcagggcggctacgtccttgcggataagccggaaaatattacggttgcacagatgatcctcgcgctggagggcagctacagtatcgagccggaatcggtgaacgaggatgcactctgcgagacggtgtcaaaggtgatggacacgctgttgtgggatcgcgtgaacgaggagacgaagcggatcttagagagcattacgctggcggatctggtgaatgaatttgtgcgtgagtacgagaccgagcagaatatgtattatatctaatcggaaggaaagtacacatttcttttataagtgataaagtacagtttacaagggactacacagggtaggtatctgacgggaggggtgccgccagtcagattttccatgtgatgttcaagctgtcgcttgtggcggctatggtggtgatcatcaaatccaccacacgccgcttgtcatcaaaagatacattctcccaggtatcgaggtagccggaaatctggctgacctgttccgggctgatggcctccacagtcaactccgctatccttgccagaagttcctgcttgcgcccgtccagttccgctatcttcacattcacataggagaacaggacattgtttgcccccgtcagactgtccaccagcttttcaatctcgctgtctacatgggcaagttccacttgcagggcggtgattttcgggtttgcctttgccgctttcttttttcctgtcagcgtcttgtagcttgccagcttctttaccatctgctgataaacaaccgcttccagttccgaagtgatgattttcccacagccaggacagcttttattgtccagccgtttcgtgcagcggagatactgtttgccggagggattgtagatactcataagagcatacccgcaattcccgcacttgatttttcctgccagccatgtgtgggtggctttccgggcagactggattttcatgttgttcatcagcttcttgcggcaggtcagccaggtgtcggaggggacgataccctcatggggagccagtaccagcatttggtcttttaagtcgtttttcttgctggcctttacatctcgcccttgatacagatagcagccgttcatgcccgtaaaatcggcaacgtcattgacaatgactgtaccttgacttttgaaaaattcgtacacatcaaggtctgcctgcacatagacaggattgcgtaacatctgcgccagcgtggggcgtatcagctctttgccatggaacaaaatcccctgttcggcaaagtaccgggtaatgtccccgtaggaagttgtgggctgggcgtacatctcaaacatcagccggatattggccgcttcctccgggtttaccaccagcttctttgtgttgataccgtccatcttgataggctccgtatggaagccgtaaggggctttcccgcccatcttaaagccccgctgactgcgggagtagtaagcgtccgttacccgcttctgtatcgtttcccgttcaagctgggcgaacacgatacagatattcagcatggcccgtcccatcggcgtggaggtatcaaacttttccgtagaggacacaaactccacattgtactgctggaacagctccatcatgttggcaaagtccagaatggaacggctgatacggtcgagcttgtaaaccacgacctttgcaatcaagccccgcttgatgtcccgcaccagttcttgaaacttcggacggtctgtgttcttgccgctgtaccctttgtctgtgtattccttgcagttaccgcctttcaactcgtatttgcaaaattcaatctggctttcaatggaaatgctgtcctttttgtctaccgattgtcttgcatagattgcgtctatccgattgttcatattgtcgctccttttcttaaaaaagaaacggagctgctgacagttctattataccgccagcagccccgcaaatcaatgatgggtttggaaaaccttatgtcccggcttcctcactctcccgcttgtcggcgtacttgcggaacacctcataaagctgctgttccagttcccggcgtttggctgcttcctgttccggcgtgaacaccggggagagattttccagtgtgatttcctttccctgaaaagtcacgatttcgatttcctttttgtatctgatattacttataagatcacctttcctttccatgctgccgctgttgccgtttcagttccgctaaaatctccggcgggatacggtcaaccagccgccgcatatcgtccagttcgctttttaacttcgcccgttccatcgtgtcattcatcttgcctttttcgctggcctttgccctgacttccagcttttcattttccgctaacaagtcattgattgtgaccttgtattttttcagttgcccggagaagttctccatctgcggaaaccactttttcagcatggagagggcttcctctttcttctttccggcgttcagcggggtaatgccggagagaaccgcttcaatggccctcgcctgtttggagaggttgaccgcctgtttgaacagccgggtggggatatgcttccggcccgtcttgctggcgctttccccacgctccaggtcggggtactgctccaccatacaggcgtgaaaatcgtcctgccacttcgtcagattggcccggttgccgataatttctttggcgcacaggcggttgtcctttgtcagcggcacaaagaccaagtgcagatggggcgttttttcatccatgtgtaccatagccgaaacgatgttctcccggcccacccggtcaatgaggaagtccgccgccctctggaagtaggccgctatctcctttggggacttgcccttgaaaaactccgggctggcggtaatcagcgtgtccacaaaccgagtgctgtccttgcgggtgcggcatctggcctgctcgatgcggctctgaatgaaatggtagtagcggccatccggcttgacgatgtggaaattgtacttgctccggctggtgtcaatgtccgggttgctggcgtactgctcctttttccgttcatggtgggcttccagcggccccgccgggtggcccttgtgcttctcaaatcgcaaaattgcgtgttgtgccattgaactcctttccccattccattcctttccggcgggttttcccgccgaaaatatctctgataggattggaatggaatgaatgtaaatagatggttttaatctctgtatttctatataccgtcagatttccgtacttcaagaggattgattttcgtactcgccaagtacggttttcagccctccggcgtaccataaccggatttcttgaagtcggtgtttggaaccgcttcataggatttcgggtaaatgcggttgggttttccacagccctgtttctggatttccaccagccccgcatactgcaactcccgcagggtgttgaccgctttctgccgcccgcagcggagcaaagcgaccacctcgcagatggggtagtacaggtagacccgcccgtactcgtccgcccagccgttcttccgggacaactccgcccggcgcaggacaaaggcatacagcaccttcgcttcgttgctcaagggctggaatgtgggtgcttcaaaaaggaaattggggagccgggtgaaactgaacgccttttccggctggtgaatataaatcgtgtttgtcatagcgtgttttgtggacggttagaggcccgttttccggggcgaatgataaatgataccagccgccccggttgagggcttgcggagccttgcaaatcaaggcttttcccgctcttaactgtccacagcagacctccttttccgttcactttctgttttctgccgcctgtgaactctggcggcgcagtccgggcagtatttgccccggttggacttcgggacgaacacaccgccgcactccgcacagcgtttcaagtccctgtcccggtaaatctccgcttccagcgtcctgtccagcggcaagaccgcccagcggaaccacttgcagcagacggagaacgaaatcatctgcggacaggcgcaggtgtcgccatcgtccagcgcaaggcagtttccgtcctcgcagttgcagcactcccggcgtatcaggccgctggctcgtctcttctggggcggggttatgcggtagggggagccgtccggcctgtgttccagcggcggcaggtgttgatagggtcttttgctcatgcgtccctccgttttctttggcgtgttctgtttccaaggtgcttgtccatcgatgaactatcccaagtctacacctttttgaccgcctgtgccgtatatccaagaggtaggaaatcagcctgaaaaactccctatttccacgctctcggatttgtgatataatcaaaaaaagataaaagacaaattcaggtttctggtcttcttgcacaaaataaaggaggagctattatgcaaattgtttatattccaagcgaatcaatgtctgttcaaggtaaaaaagatgaaatctataaaagatatgggaaagactggaatattagagaacagggaggaggtaacggaaattggttgttgaccagaaaaagtgatgtgcttgtagatggaaaaagttatcgtacttttgtacttgaacactacggtaaatccaagctgacagcgaagcttgttgataaatttcgtgaagatgtagcaaatggtaaaataaaactgtaaatgcctatgccgttatgctatgagcatagtacatagcataacggcttctctttcgttgagctagcaaggagggtgaatatgtctttatccatacaagagcgattaaaagacctacgtgtggagcgtggcttgacgctggggcagcttgcggagcagaccgggctttccaagtctgcgctgggcagttacgaaacggaagacttcaaggacatcagccactatgcccttatccggctggcgaagttttacggtgtgaccgctgattatctgctggggctgtctgaaatgaaaaatcacccaaacgccgatcttgcagacctgcgtttgagtgatgaaatgattgacctgctgaaaagcgggaggatagacaataccctgctgtgtgagctggcggcgcacccggatttcccccggctgatggctgaccttgaaatctatgtgaacggaacggcactgaaacaggcgcagggtgcaaacgccatagtggacacgatgagcgcaactgttataaaaaagcataatcctggcatgagtgatacgcagttaagacagcttatcaccgcccatattgatgaggacgagttttgccgctatgtgatacaacgggacataaacgggattgcccttgctctgcgggaaacacacaaggacgattttttcagcgtcccagaggataacccgctaaaagaaatgctggaaactgctggtgaaatcgtcagccaggacagcgacacggaacaagcgtacttggcgtttatctgcaaacggctcaagctgaattttaggaagctgtcagtagaagaacggaagtggctgaaaaagattgcggaaaaatccgacttgctgaagaatccaaaaccgcagagaggacgaagataaaaaatgcctgaacggcggttctggtttttcagaaccaccatccaggcattttgtttagtaatagaaaaaggtgcagttgattattgcgtattgtcaatctctctcaaaccgggtagtaaaaatacggcaagcgcaacgatgataatgccaattccgcaaatgacaaaccatttctcaactcccagccgctccgccagaggcccggaaatgacaaggccaaacggcatggcgagggaagcggcgcttgtcagtagagaaaaaactctccccagatattctggtttgaccgtttcttgaaaaatcgcattttgcacaccgtaaaatggagcggaaattcccataacagtacagcacacaacaaagacaagaaatgcgtctggcggcaaaagcccggagagcatattgctaacgcccatcaggagaacggaaagaccgatggtgtaccgccgtttcttaaaaccgccccaaatgctcagaatgactccgccaagcagcataccaaccgcaaaagcaatttcagcggcagaggcatgggccggtgttcctttgaagtatgacatacagatgagaggaaaaagcgtactgattggcatataaaagaacatataaattacaccaatccagagcagagcaaagaggcccctgttttgctttaataccacatacccctctttcatatcctgtaaaaactgttgtcttttcgtttctggacatagttcaggcgttggtatggacgaaatcgcaacagtcacacaggcaaggattgcacccacaatatctaacaatataattgcattaagaggccaaacagcatataaaaacgctgcggcagctggactgataatcgcacttactgcttgcatggtcgacgtgtaaccagcgcattttgtaagttcctcttttggcacaatcataggtgttgctgcgctgaatgctggagaatgaaaagcagttcccgcacttcggattaacaggacaaccataatagaccatacgggcaattccatgtaaaacgccaccagcgccagaataccgccagcggcggcaattatcaaatccgcaccaatcattacgcttttacggctgtgccggtcaacaaaagcacctgcaaacgggcctaaacaggcttgcggcaaaaatccaatcagtgttgccgccgtcaatatgattgcagaattagttttcgcaaccaaataaaagataatggccatttgcaaaataccgctgctaataaaggatattgcttgtccggcaagaagtgtaaaataagtttttctccatgaattgttgttttgggtcataatgcgaacctccttttttattgcattgttcctttgtttctgcaataaaaagcaggcgttgtcccacagagagggcagacgcctgcataacaacaaagcacgaaaaaacaccacgatacagttcaaagactgctcgtgtcaaacctacgtgttcctttgcatacgcacgcaaaaaaagcccaccatcatgtggaaaggtacttctactttttattgcttattagcgtacacaaattaacacacgtaagcctccttccaatctcaaactgtcgcacagtataacacacatccgatagacttgtcaaccatttttaaccttgttttccatcttgtttttccatctcttacgggcagtagcaaagccaggcgagccagtcaacggtcaagatgaacggcgctttcagcgccgccgttgacagtctcgcccgtctttgctaatgggtaatcaaggcgggaaagccattttagggctttcccgcccatttcaattttgggagaagaaaggccccaaaatgaacgagtgcggccaaacacttttagggattggccaccttgtccacccatccagcggggcggcggggaacggtcaaggccgggcgtcagcccattcatttcagccttgacggtttcctgccgtcctgctacttttcccggagtgtggccacacatctggtcacggtgtccagagctttgggactttttgtcccataggccgggggcggaggacgagggacgggggctttcataatacgccctgtctgctgctgaaatcagccctttgtttccggcttaccagccccaaacaaagccctgctttcctgccgcgtcaaatgcccttgccctccccggcggcaacggtattttcagggcaacgccgacagagcgtataacacactacactttgctccgcaaagtcgtgtgccaaatggggcgctgccccctttggaaacccccgcaacaaacaggtgctatgcacccagccgggagcatagcgccgtttgttgtcagcagcccgtttcacggtctgcgtgtagttccttgtaaactgacctaagtaatattataagaaacacacttgaggatttcatgtggaaatgcaactgggaattcgttggagaaaaatgtgagcatttcttccgacggaatgtttgcatctgattccgtgtctcttccacgtttggacaatccgacggggcatgtccgacacaccggagacaatgggcggactttctggcagcactaactgcactccctcgtagacatgataaaaccgcgcgaacagaaactcgttgccacctgctattgaaattaaggcaggtgacaactcagacatctgcttcgcgcggttatgttttactgcaacataaggatggctgatttatgccatccgttgtttggtgctggtaagtgctgcacgaaagtcctacaaattgtcttccgggatgcggacatgacccgcggagtgctccaaacttggaaagacacggatcatcgaagatgcaaacatccggctggttagaaatgccacattttttgatccgaatttccacctgcatttccatctgaaatcccgcggtgtgatcttctaataatattacttatctttttaaaagaaaatggtacaatcagtcgccgtccggctttactcagggtcagatccgatgcagcttctgctcatatttttcctgacgaaccggaagacggaacggattgttgacatagacgatcatgtacatgccggctgctgtaatcatacctgtcacaacgtcgaagacggagtgctgttttaaaaacatggttgagagaatgatgctcaccatgaggatggcggaaccgcagcgcattgcgtgtttgtgcttgaacgcatcggaacgccataccgcaatattgaccgcaatcgagttgtatacatgaatgcttggaaacaggttcgtcgcggtgtcggaagcgtacagccacttgacgatatgtacaaaaatattatcccgcgcaaaggttgtcggtcttaggtaatgtccgttcggataaatggtggacacaatcaggaaaattgtcattccggtaaacagcattgcgcacagccggaaatattcggaacggtcttttaaatagaaataaccgatgccccagccgacgtagccgaaccataacaggtaggggatgataaaatattcacagaacggaatgtaatcatccagcgcggtgtgaatgacatgaaaatgtgtggtgacggtcttctcgagatgaccaaaccatggaagatagattgcaaaataagataaaagaaacagagccttgtttcgatcaataaagccactgattctctgacgaagttctggtttcataatatccatcctttctataataaatagcagtatatccaatttcttcacgtttgcgattatagcacacgcatttctgcgagacaatcggctttctttttttttaagaaagattatttaaaatttaagaaaacgttcatacatcgaaagatcgtttgtgcatttatacaataagaaataaaacgaagattttacataattgttacgattgggggaagttgttgacaaacaaaaagggtcatttataataaaccatgtgttttcactgaaagaacaggcatataaatgtttacgataagaggaaaggaaacagaaaatgaaaaagaaaatcgggattaccgcggcagtcattctgggaatactcgcagtctgctatatcggattcgcggtgtttttccagagccacttctgctttggcactacgatagatggcattaaagtgggaggatgcagcaccgtaaaggtggagcagctcatagaggaggagatcggaggatatgagctgactctggtggaacgcgaggatcagacggagaccatcacggcatcacagatcggcgcggcgccggttttccacggggagatagaagaactgctggcggatcagaacgccttcgcatggccggtgattctgtttggaaagagtgcactggaactggaaaaaacggttgcctttgacgacacaaagttttccgggacgatcgaagcgctttcctgcatgcaggaggagaatcagagaaagccggtggatgcgtcctgttccggctattccgcagcggacggctatacgcttgtcccggcggattacggaacgacgatcgatgagacagcgttgaaaaacgcggtggcagaagccgtggaagggctggaggacacactcgacctggagaagaacggctgttatgtggacccggcggtgggagacgacgacaaagatcttctcgccgtgatcgacgaattaaaccagtacgttgcatcgacggtcacctacgatttcggggatcagacagaagttgtggacggcagtacgatcagcgagtggctttcggttctggacggtgaactggaggttgacgaggaggcggtgctcgactatgtcaagggacttgccaagacttataataccgcgtacaaaccgaagacgttaaagacttcttacggaccggaagtgacgatttcaaacggcgcttacggctggaagattgacacggagggagaggtggcacagctgcttgaggacatcaagtccggcaagagtgtggagcgagagccggtctattcccagacggcgaacagccatggcgagaatgactacggcaattcctacgtggagatcaacctgacatcgcagcatctgtttgtatacaagaacggaagtctggttgtggacagcgattttgtatcgggaaatctgtcaaagggacacggttctccgaccggagcgttcagcgtgacctatacgaccacggatgccgtgctgcgcggagaggactacgcgacgccggtaaaatactggatgccgtttgcgggagacgtcggcatgcatgacgcgagctggagaaaaagcttcggcgggaatatttataagacaaacggatcgcacggatgcatcaatctgccgacatccgtggcaaagacgatctacaatacgatcgagaagggctggccggtactggtgtacacgcttccgggaacagagagcgccgcacagctgcagcaggatgtgcagaccgtgattgatctgatcaattccatcggtgaggtaacggcggacagtgagacagtcatcgcgtcagcgcgcagccagtatgatgctctgccggattctacaaaggcgaatgtgacaaattacgatgtgctcgtggcagccgaggcatcactggcacagatcaaagcggcgggagagcagacgggaatgtagtctgtctgccgcatggaattgtcgcaataagcatagacctcttttgggtgataagtaatattatcagaagatcacaccgcgggatttcagatggaaatgcaggtggaaattcggatcaaaaaatatggcatttctaaccagccggatgtttgcatcttcgatgatccgtgtctttccaagtttggagcactccgcgggtcatgtccgcatcccggagacaatttgtaggactttcgtgcagcacttacctgcacttccgcagtaaaacataaccgcgcgaagcagatgtctgagttgtcacctgccttaatttcaatagcaggtggcaacgagtttctgttcgcgcggttttatcatgtctacgagggagtgcagttagtgctgccagaaagtccgcccattgtctccggtgtgtcggacatgccccgtcggattgtccaaacgtggaagagacacggaatcagatgcaaacatttcgtcggaagaaatgctcacatttttctccaacgaattcccagttgcatttccacatgaaatcctcaagtgtgtttcttataatattacttatcaacgcaaagcatgatatgcttattgtgacagttttttgtttcatggaaaattatgtaataaaggagagacgaaatgatacaggatattttaccactgcatctgcagaatcagtacgaaaaaaaacagccggacgataccagctatatgatgatctacagggagaacaagatccttgtaagggagggagagacgcttgccttccttacttaccgggaactccgggagatctgtgagacggcgggagaaatggcgccgcagagcatctatctgttttccgttggggaggagacgtattttctgacggaactgccggagcatctcacaccggaaggatactgttttgaaaaaatgtttgcggtgcggtcgggaaagccgaaggagcacatccttgcggctgccacggcatggcatctgtacgagtggtatcgggataaccggttctgcggaagatgcggacagaaactcatgcacaacggaacgctgcggatgttattctgtcccgcatgcggcaaccaggtgttcccaaagatcgcaccggcggtgattgtcggggtgacggacggagagtatattctgatgacaacctacgccaacagggagtacaaacggtacgcgctcatcgctggatttacggagatcggggagacggcggaggagacggtcatgcgggaagtgcaggaggaagtcggtcttaaggtgaagaatatccactattataagagccagccgtggggatttgaccagaaccttcttcttggttatttctgtgaactggacggagagcgggatattgtgctggacacgggagagcttgcgacagcggagtgggtgcattattcggatgtgccggaagatccagaggggctgtcgctgaccagagagatgatgtctgtattccagaaaaattttacgtctgagaaaatgtcttgacagtcaaatgaacatactgtattattacaatagtacaaagaaactttaaaaaaatggtaggatttcctaagaattcttaagttttacttaaacccattttttttgaggggtgataatgatacaatcaccataaatttgtaaaatacaggtaagggagagacgagaatgaaagacaagaagcaaaaaaacgagcagaatgcaggcgcgatagcagcaaagccaaagaagaaaaagaaggtactgatcgttgtgctggttattgtggcagttctggtggtctggatcggtatatccatacataacgcgaccaagcaggtggcgatggcggtgaataccgtggaagtggagccggtacagaagagggatctgtccgatacgatttcggttaagggaacggttgccggagccagcagcacgaatgtgacgtcaaaggcggcgtccgagatcacttccatgaatgtgcaggtcggcgatatcgtgaaagagggtgacgtcttatgcacactggactccacgtcgatcgaggagaagatcgcagacttagagaagtccatgtcgaatgcgaatgcggtgagcagcatcaatacacagcaggcggcggacgccctgcagcaggcgaaggatgaccagacaacgacgcttgcggcggcgcagaagacactcgaccgcgcaaaggacagctacaacggcgcacagatgctctacgatcagggacaggcggatttcgctgcactgctcgctgccaagcaggcggtggaggatgcgcagactgcttatgatacggcagtagagaccaccaaccgtgcgattgagacagcacaggaggcacaggagctgaacaagtacaaagacaccgacacgacatccaaggacacactcagcaatctgaaagaacagctggcggactgcgagatcacagcgccgtgcggcggtgtggtaacagcggtgaattccaaggtcggagacatcaatgcagagaagaacgtcatcatgacgattgaggatacgagttccttaaagatggttgcaaccgtgcaggaggcggatgtattaaagcttcaggaaggcatggaggcaactgtgaccgcagatgcgacgggtgatgagcagatcaagggaaccgtgaccagagtggtccgtgtgaagagtcagggcacgacgggaagcgacggcagcacgacttctgccggtggttattccattgagatcgcgctcgacaatcaggaacttttaatcggaatggctgtgaaggcaaaagtcatgatccaggcaaagggagaagtgctggcagttccgtatgatctgatccagtatgatgacaacgggcaggcgtatgttcttgtggctgaggcggacgatggcggaaacgcaaccgcagtgcgcaggaatatcacggtcggcgatgaggtggattattatacagaagtgaccggcggtgatctcgcagagggagatatgctgatctacgacacgacattttcgatagccgagggacagacatttacaccggagcagatgtattctgaacaggatatgggactgacagacggtacaggtacggaggttagcgaatagtgagtgaaccagtaatccgaatggaaaaaattgtaaagacatattatgtaggtaagcccaatgaactggaaatcctgcacggaatcgatcttaccgtgaaccagggagagttcgtttccatcgtcggtgagtcgggttccggaaaaagtacattgatgaatatcattggagtattggatagacagacctccggcagctattatctggaaggacaggacgtcaacggcatgacggacgaggtgcggagtgcggtccgcaaccgcagaatcggctttgtgtttcagaactttaatctgctgccgagagccaatgcattgaaaaatgtcatggtgccgcttatatatggtgaggaaaagacgaagaatgcgaaggagcgtgcgatggagatgctggcgatggtgggaatggacgggcgtgcagatcacagaccaaatgagctctccggcggacagaaacagcgtgtggcgatcgcccgcgcgatgatcaatgatcctgcaatcattctggcggatgagccgaccggagcgctggattccaagaccggacatatggtcatggatctgtttcatcggttacatgaagagcaggggaaaacgattgtactcatcacacactcccaggagcttgcgacggagacacagcgtattgttaccctcttagacggtgagatcgtgggggacaacaggggaggtgagcactgatgttttttgaaaacataaaagaggcaatcatcagtattctgtcgaacaagatgcgttcactgctcacgatgctcggtattattatcggtatcagttccgttatcatcatcacgacgatcggcggttccatacagagcaccctgaccgcgacaatgaattccctcggcggcaacacagtttccggctatgtggaggcgcgctatccggaggacgatgcagactgggatacctggatttatccggatatgacacagagtgattatgtgtcacaggagatgatcgatgaactggttgcgcagtatccggatgaaattcagggtatcgctgccgagaattatcttggaggcgggcagatcaaggatgaggcggattccgacaattatgccaatgtcagtgtggatggcatgacaccagaacagttcgagtatatgaagcttgagatgcaggcgggacgtaatcttaccagggcagacaatctggggaagaaaagagtctgcgttgttgcggatacgatggcaaagaattattttggagacaaagacccgattggcgagacggtatcggtaacaatggacgacggatcgatctatgattttgttgttgtaggtgtttacaaatacaatgcggcactgtttggaaaagtggatacatctgtcagagaaaaggatcgttccacttatatgatgattccgatccagaccagcttcaagctgcagggggcagataagactggttatgaatactttaatctgctcctgacgccccttgcggatgtcaaccaggcaacggaagatatccagaattattttgatgaggtatatcagaacaatacgaatttccatgtgacagcgagcaacatgcagtccagcatgggcatgatcaacacggtgctcaatgtcatcacgattgcagtatccggaatcgcagcaatctcgctgatcgtcggcggtgtcggtgtcatgaatatcatgcttgtgtcgatcacggagcggacgagggagatcggtgtgcgtatggcactcggcgcaaagcggcggacgatccgtatgcagtttgtcattgaggcgatcatgctctgcttaatcggcggcattatcggtattctgatcggtgttggtgtcggagcactgctcggccaggcagcgaagtttgtgattgccaatatgtattccgagtattccaattacattattatgcaggtgcatccatcggcaactgcaattttactgtcactgttcttctcgatgctgacaggagtgttcttcggttattatccggcgaacaaggcgtcaaagatggaagttatcgatgcactccgctacgaataggcgtgtgcagccaaagatgacagaaaaaggggcagagaagctttaccgcttctctgcccctttgctgtcattttgcgtgaaaaaattgaaatctgctgtcaataaatgtataatgataatataaagggaaaatgatcgaaggggagaatgagtttatgacggatgttttgttctatcagaattatacttatgtagccgatatcagcgcgattgtgctctgcatcatctgctggctgctgttgcattcttcctatacggtaagagagaagagcctgattatcttcaaagcgggaacggtttgcctgatgatggcgacggtctgcagtatcagtttccatacagcaatcacacggattacagaatcccggaagattcttatttatgtgttacaggatgggatatatcttttactgattctcacgtttgtgctgctctgcaattacttcggtacacttcttaagctggaagagagaccggcaagactcttgggcgcggtatcctggggcggctatgcggtgtttgcttttcttgagatcggatcaccgtttacgcatctgggtttttatatcgatgcagatctgatggttcatcagaatttctattttgatccgtttcgttttgcctatatttattactgtatcgttcttgtcgttgtgctttttacgtaccggaagaagttcgtgctgaaaatgctgcgctgccttgcctatattttactgttttcgtttggcatgattgcactggaggcagaatatgtatctacatcttatagctgcatggcactattacttccctatatgggagtgctgtttttgtttcattatacatcttacgacagggagacaggaacacttgatgctggtgcgtttgacagctatctgagagatgtgggggacgatgatttttctgtaatcttcatgggattcccggaaaccaatctcaaaaagataccagaacttccgcgtacgattctgacgtttgcggagaattatttcaaaacattctgcctgttccgtctgcaggatgataagcttgcactggtgtatcagagactgagtaataaagcggagaaaaacggaaaatataacatacaaaaaacgtttgagcgtgtgtgtaaagaacatggactgggctaccgggtgctgattgcacatgcagatgacaggctgcgtgaggcaggtgagtatctggcgttgaatgagtttatggaagagaaaataccggttggcgcggtatatgagtgtcagaataaggacatcatagaatatcggaaggcatcttacatattaggcgaattaaaggacatcaatgcacactgcgacttggaggatgagcgcgttaaagtgtactgccagccggtgctaaatacacgtaccaaccggtttgcctcggcggaggcgctgatgcggctggagctgccggaaacaggaatggtatatccggatcagttcataccgatggcagagcggcacgattatattcatacgctcagcaaaatcatcttaaataaaacctgccgccagatcaaacgcctggagcaggaggggtatcagatcgaccgtgtttccgttaatttttctattctggaattccgcagaaaggaattctgcaaggatgtcatggacatcatccgccagaatgaaatcccgtatgaaaaagttgcgattgaactgacggagagctggaatgagacggaatttgacaacattaagaatacgattaccagtcttcagaagctgggaatcaaattctatctggatgactttggaacgggctactcgaatttcgagcgcattatcggtctgccgatcgatgtgatcaagttcgaccgttcgctgactattttggcagggaaaaatgcagaatcccgctatatggttggaagcttttccgatattttcaagaattcgcactatgagattctgtttgagggtgtggagaacgaaaaagacgaggatcagtgcaagcagatgaatgcactgtacctgcagggctacaagtattccaaaccgataccgatcgaggaactgacacgcttcctggggcgggcggtgtagaatacatccggcgtgcaaaaacccctcagcgcatctcgggggtacggaagaggaaagccgggacaggttaagaacagaatgataaaatgttccgggtggaacttgccggcagcagttctgatcacaaaatccggcatttctaatccacaccgcgcctggcatccccgatgatccatgtctttccaagctttgaacactccacggatgtgtccgcaacctgcagacaattttaggattctcgtgtgcctcttatggcactgctgaaaaaaacataaccgcgcgaagccgatgtttgaattgccatctgccctgtttttaatagcagatggcaacgagtttcggttcgcgcggttttatattgtctgtgaagcagtgccattagaggcactagggaatccgctcattgtctgcggtttgccggacacatccgtggattgtcaaagcgtggcaaagacacggaatccgatgccaggcgcgatgcggaagaaatgctcagattttgctccaaagaaccgccgccggcaagttccacccggaacattttaccattctgtttttacctgtccctgcttttctccgccgtgtccccgggatacaccgggtttttaggcatctatgattcgacgaccgccagcccccagggagccagtgtcaggacggcaccggcggcaaccggggtgtcggttaaaagatcggtgcccgcatttccggtgtggatcactgtccgcggttctcccgaatagttgaagtagtagcacagatttttgccaaaatcgtttgtgccgcgctttacgatcagcggaaactgcggtgtgtcttcggaaagaccttcatacccgtgtctggagaggtaggatacgagcagcggctccaacagttcatcatcgaagaaagcgccgaggtagagggcggagcccttctgataggcgttctcggtcacggcggcataactgccccagaatggatggtcataatgcgcgagcggcgtcgcggtgtcacaggtgacaagctccatccagtcgtgtgtgagggcgctcctgccgtctgtggtggcgatgcggacattcttcgggtaggtgaactggtcgtagtgaatgccaaggcacctaccaagaagatgtggctgtacgtcgtggtggattttcaactgttcgtcggcgaagccggtgcggaaagtggcgatcaggtgtccgccttctgccacgtagcggtcgagcgcgccgaggagatcgtcggatgcggcatagagcgccggaacaacgagaaaatcataggcggaaaaatcgcgctcgccggaagagaccatgtcaaactcgatgtttctgcggtacagggcgtcggcaagccagcgcatcacggcattgtagctgtggtcaccggtggtctcaagcggaaactggcgcagccccgccagggagagattgtccagcaggatggcgacgcggttttcctttttcagattcatgaggtgtgtgccgatgcgcttccactccgcgccgatttcgctggcttcccggtaggtggcattttcggaaaaatcgtgggaaagcacgcctttccagtagctttcgatcgcattgtggatcgagtgccagtgccagtacatcacgctgttggagccatttgcaaggtggctgtacgcctgcaggcgcagctgccccggataggggagccacggggtcagaccctgcgcctctgtctctaagatcagataattgtccttctttaagctgcgcgcaatatttccgcatacagtgatctcagctccggtcaggtcgtcctgcgaaggatggtaaatatcggcgcctgctacggtcatgcagcgggcggcgtcatactggtcgacctccggctgatagccgtaagagtgatcggtccagtcaaaatcaaaattctgcgtgatgaactggtcgtcacgtttgtactctttgataatgtccgattgccaggagaggaactctgtgacgagggagcgctgaaaacgctgaaattctgcggcaagactctggttgatcgtgccgcgtacatccggaaaatccgcccagtcgttcacgcggttgctccagtaatccagaccgaattcacggttgaaatccaaaatgtccgggtattttttcttcagggaagcgacgaacatctgctgaacccgcggacctgccgtcccgtagctcttggtctcgttgtccagctggaagccgatgatgttcggaacgtcctttaagtgctccatcatggcgcggatgatgcgctcggcgtgataacggtagccggggtgcgtgatgtccatgttctgacggtgaccgtagagctcctgcccgttcgcagtgacggcgagaatatccgggtatttgcgcaccagccaggtcggaatcgcgtaagtcggggttccgatgatgacggaaagatgatgctttgcggcggtctgtatcatgcggtcgatgcaggtaaagtcaaagacgccgtcggacggctctaaggtgctccaggtggactcggcgatgcggatggtattcatgccggcacgctccatcatttccatatctgtctccagacggttatacggcaaatattccagatagtaggctgctccaaagagcaggtgatctgttctcatatcgggtgatctccaatcttttctaaaattttctataagaagtagttgttttgcacatgctggcacaaaaaacgtgcaaccgcttgcgctttttcattatatcatcgcaaaaatgaactgtaaacaacagaaagtaccgtaaatactgcaaaatatgagagcacatttttggtaaaaaagtggattgatttttctggaattgtgtttgataataaaaaaagattgcgcaaccagcgcaaaattaagggaactccggacgatagtccagagttggaggttactatggagaaggaagagaaaaaagatattaccattgcggacgtagcggaggcgttaggggtttcaaagacaacggtttcacgcgcaatatccggaaagggaagaatcgggaaagagacccgcaagagggtcatggaatacatagaggagcacgattataagccgaacgctatcgccaagggattggcacagtcgaaaacgtacaatatctgtgtggtaatgccgcgcgattatgaagtggtggactggaatttcttccagcgctgcctgttcggcattcaggagatggcggagaccgtcggatacgacattctgcttacgatgtgtcagatgaatgacatttcctcactggagcggattgttgcaaatcataaggtggacggtgtgattctgatgcgtacctttctggaggatgcacagattgaattcctgcagcagaaaaatattccgtttgtgacgacaggaagtacgaattatgagggtgtaatccagatcgaccacaaccacagaagtgcctgccgggaattgacatccattattttaatgaagaatttaaagcggattgcactgatcggcgaggacgagggatacatggtaacgcacagccgtctgctcggattccgggacgcctatgaacagcagggggagacgctcgatgagaatctgctgtatttaagcccggaaaaccgggtgcgcgtcgatcggacggtaaaggagatcctggaacagaatgtggactgcattctgtgcatggacgatgcggtgaccagcagggttttaaaggtactgcgggaacagcacgtcagggtgccgcaggatgtgcgggtggcatctttttatgacagcacgattctcgagaaccatgtgccgtcgatcacttcgcttgctttcgatgccaaggaacttggaaaagtggcgtgccggacgcttttagatcttgtggagggactggaggtaaagcagaagacattacttccatatgaggtcgtactcaaggaatccacgaaatagtgcacaccgggcagtgcggattgtgtcggaatacggtgtctgacacgccggaaatggtgcagggaatgggaaaatcagcaaaatcgctcaatatgcgcttgaaatgttggaaaatataaagaaaacagtggaatatgcttggaatattcgggtttatcggttgcacaaaaataatgaatgattccacgaaaagctgatatttttttaaaacttgtgcatttgtgccaaaaaaaaagcaaatttattataaaatataaacattgacatcaaaacaggcacgtaatatactttaatcatagaacaaccgattgcgcaataagatgcgcagtaccgcaggtacgatacggaattgggcatgcggcgttctgaaaaagttttgaaaaagaaaagggaggattttcaaaatgaagaaaaaagttttgagcgcattattatgtgcgagcatggtagcaaccatggtagccggatgcggcggaagcagcagcgagacaacagacagcaatgcagcagcagacaacagcgcagcagacaacagcgcagcagcaggtactgaggaagcagcagctcctgcagcaagcggagacaccattgctttaagagtatgggccgctgaggaagaccagacattaaccaacgagcttattgagcagtttaaggaagcaaatccggatcagacatttgacattacagttggtgtagagtctgaggcaaatgcaaaggatgatatcttagttgatccgacagcagcagctgatgtattcgcattcgcaagtgatcagctgattgatcttgtagatgcaggtgtattacaggcagtacaggatgttgataccgtctccagtgagaacgtagcaggtgctgttgaggcagctaccgtagacggtacattatatgcttacccgatgtctgctgataacggatacttcttatattatgacagcaatgttgtaacagatccgaccaactgggatgcaatccttacagactgtgcagcagcaggcaagaaagccggaatggtgcttgcaagcggctggtacaatgcaggtttcttctacggagcaggatttacaacagtattaaatgatgacggaagcacagcaatggactggaacggaacatctgctgacggtatcaagggtaccgatgttgtagacggtatgcttgcaatcgcaacaaacccggcattcttaccaatcacagacggtgatacagcaaaccagattgcaactggtgagcttggtgctatcgtttccggtacatgggatgcagcagcagtacaggaagcattcggtgatggatatgcagcatgcgcacttccgacttatacatgcgctggcaaccaggttccgatgggttctgcagctggttacaagatgatcggtgttaatgcaaactctgcacaggttggctgggctatggaattagcaaagttcttaaccaacgagcagagccaggagacacgttttgctgagagacagatcggaccgtccaacattgcagctggcgagtctgatgaggttaaagcaaatgtagcaatcgctgcagttaccgcacagaatggtgctaacggtgttgttcagatagtaggcagcggttactgggatccgtccaaagcatttggtgagatcattgctcagggtaacccggacggaacagatgtacagacattgctggataatctggtagagtctgcatcacagccgacagaataagcagtaacacgattttataagagtgtatgaagagaaaaaggcccgcatacgaagatgggaatcgtgagtgggtctttttcttcatctgaatatcaacagaacccaaagaacacgcagaacaggtatacactgcgtgcagcaaagatacaaggagaacgccattttacagaaaatgacggttatggaaaggcatgggtgcttgcatgaatagtaaggaaggtaaaaagaatccggtggctgcattcttcggagcaatcggaaaattctttaaggaatttggtgaggctgccgccaaaggggacggtgcagtgaaagcatcgctgctcgtagcgggtgccggttattggaaaagaaaacaaatcatcaagggatttctggtaacattactggaaatcgggttaattctatatacggtattgatcggggtgccatatatcagccagctgaataccttaggtacggtagagcgtgcgatggtgtacaacccggcaacgatgaagaatgaggtcaatgattatgataactcccttctgattctgctcttcggtgtcatcagtctgagttttctcattgtgggaatcctgctttggatggcaaacgtgagaaatacataccgcttacagcttcgcgctgaagcgggaaagcacatcaatacatttaaggaagactgcaatgagatgctgaatgataagtttcattttacgttgctggcgcttccggttctgggtgtgattatctttaatatcatgccgttggtcgttatgatctgcattgcatttacgaactatgataagagtcatatgccgccaaatgcattgtttacctgggtgggacttgcaaactttaagtccctgtttaccacgagcattacctccacattcggatatacattctggagaattctgggatggacgctgctctgggcagtgcttgccacatttacgacctattttggaggaattattctcgcccttctgatcaacaacaagaacacaaaattaaaaaagatgtggagaacgctttttgttgcagctatttccgttccacagtttgtaacattgctgttgctgcgtaactttttcgcaaacacaggaattgtcaactcattctgtaagagcatcggcctggttgatctgttacagaatcttggctggatcaaagcaaattatattccgtttctgagcgatccggtctgggcgaaaatcacgatcgttgtcatcaatatatgggtaggtgttccttatctgatgctgattgcaaccggtgtacttatgaacattccggaagagttaaaagagagtgcgaagattgacggagcaaactcattccagattttccgcaagatcacaatgccgtatatgctgtttatcacaggaccatacctcgtaacacagtttacggcaaacatcaataactttaatgtaatttacctgctgacacaggatatttacacaacgaccaaccagaaactggcggcttcctggggtaaggagattgatcttctggttacctggctgtatcgtctgaccagtgagcagtacaactataagatggcatccgtcatcggtatctgcgtctttatcgtatgtgcagtcattacattatttgcctttaacttcctgattaaaggagataaggaggatacattcagatgatgggaaagagaaaaattgttaattccgttttgcttcacgtagtgcttgcagtgcttgcagtgatctggatcacgccgatcgtgtggctgattgtaacctcgttcagcggatatgacggcatgaacacgagccgcttcttcccggagacatggtcgatccgcaattatactcgtatgctctttgaaccggacacggtatcacagttcccgatctggtttaagaatacgttggttattgctatttttgtatgtctgatttcaacttcttttgtattgatggtcagctatgcaatgagttgcatgcgtttcaaaggaagaaaagctctcatgaatatcgcagttatgctgcagctgttcccgggctttttgtccatgatcgctatttactttattttgaagtccgtcaacttaaccaacagccatatcggtatgattctggtgtactccggtgcatccggactgggttaccttgtggcgaagggattctttgatacgattccgacatccctgcgtgaggctgcgtatctggagggtgcttccgaggcaagaacattcttcacgatcgtgcttccgctttccaagccgatcattgtgtacactgttatcagttctttcctggtaccgtggacagatttcgtttttgcaaagatcatcttaaactccggtatctcgacagactggaccgttgcgatcggactttacaacatgctgaatcgtactctgatcccgacatacttctcgagattctgcgcgggcggcgttatggtcggtatcccgatcggtattctgttcattatcatgcagaagttctatgtagaaggaattaccggcggttcggtgaagggataaatagcgaagggaaatactattgcaggcattgcagcattggctgcaatgtctgagtatttccaacttcgcattagaaaaatgcaaaagcggcatttttcaaagtgcaatacaagtttttaggtaggcgggtgaggatgcaccaggcatctttttcataaaaatgaaagaaatatagaaattgaggaggaagaaaatggatcaatttattttaaatctgattcacagaccagagatggttccggagtattccgcaactgtcacaggacagggaaaggaagaggacatcggagacaaggctctcttgacagaatctctggatattttcaagacacagcagagactcgcacatgagaatgggttaaaagtaaccattcagatgacatacgcatctcttttcaatgatgaggcagtggagattgcgaagcatgaccacgacgtatacggagacgagatcgcattatctctgctcggacttccgtgtgaggagttccgtgagaaatacaagaccaaggacttctgtatctggatgttctccatggaggacaaaaaagccatcgtcaacgatgtgtttgagaagttccatgacagattcggattctatccggagtcaaccggttcctattacatggatgccgatctgactaactatatcaaggcagcttatccgaccgtaaagtgtgcggttgccacctgctgggaggaaggtccgaaagcttaccatacctgcaacaactcctggtatacgttattcgacggcggcccatgggcaccgtggatcccgtccaagcagaatacacatgcaccggcagccaatgcggctgaggacagcggtatcgttgcaatcccgcatctgtcccgcgacttgatcgcatgctatgacggtaacggctccaacttcggaacgcatccgcagaatgtacttcgcggaatgatctacgatacaaagacctgggagtacccgtatctgtacaacctgatcgatcagtatcgttcgttaggaaaatacaacaacggttatgcatacaacatgatgtttgtaggaccgggctggatgaacaagatgggacgctgggagcagccgtatgagcttctctacaagtcttacagcgacggctgtgcatattacggcaagctgaaaaaagagggcaagttagtcgatatgacgatgtccgagttcgcagattactaccgcgagaagaagggcgtggatgccggcaactacaatgagccggagtgtgcgctctggagagatatcctctacggatcagacaagcagctgttctggtactgtgatccgtacatgagagcctgcgtcaatatggatcagggcggtgcaatcgtcgaccttcgtccgtatgcagcgaaactggagtggccggttggtatcggcacaaagcatgtacaggatgcctcttatccgttcctgattcaggagaagtaccgtgcaggttacttcacacattacgcaggagagggaactgtaagaagtgcgaagctttcctacaagggtgaggaagtagatctgtgtctctgcccgacacacgcacatttttcacaggagggaaagacaagaatcctgacactggatccggtaacgatcgagttcagagatctgactgtaaagcttcagacaaaagagtactttgaggaaggctcctccaacatcaagatcgagcgtaccatccttgagatgagtgacccgagtgcagaggttaccttaaacgagtatatggttgcatgctacggcacaaccgagtattccgaggatatgtcccatatcaccttaaagatcgacggaccggaagagaagacgatccattatgagtacaagtgccgcgaggagggtgtcaagggtgcgacagaagtaagcgccgtgattccggagatcgagacacgcgtatccatgactgcatccaacgcggacgcagagggatatgtaaaagagggatatgcattctcaccgatgtttaccctgggatacagaaaaacaatctcagataaggaggtatttgcaacatggctcaacttggcaaaggcaaattaaattatagatgcccgtcctgctttttaagagatctggacattgatatgttttacaataaggaaacaggtatttacagctgtatccgctgccagtacagaggaacagaagaagacgtcctggagaaaaatgagatgatccgcttccgctataaggcaatgcaccagcggttcgacaagttcgactttgattaagctacgagcagtgtagagaaatccagtgacaccggaggaaagcttgctttccagaggtgttgctggatttctctatagggcgacagcccacagcgagacggagcgaagtggaatcgagctgtcacggcgaggagcgcagagctggttgcagaagaatgcgacagcccacagcgagaagaagcgaagcggaatcgaactgtcacggcgaggagctttacgctgccacagcggggagaaaatggagtaattatggggaaaaagaagaaagataccatcgagcttcggttctatgagataccgcaaaatgaatatgttctggcacttcttggagaaaactggatccgggattatggtcatgatgaggtacatcttcattttcacaatctgatggagatcggagtgtgcagaaacggtacggggaaactgattctggacgaagaacagcgcccctatcagcctgccatggtgagtattataccgaacaactatcctcatgtgacgatcagcaatacaaaagaaggaccaagctactgggaatatctgttttttgatccggcgcagattattgcggaaatgtatccgaagaacgagctgttctgccgggaactgatccggaaagtcaaccggagagcgctgtttctccatgaatgggagaatcacaatctcgcgtttcttgtccggcagatcatggaggagatgcggggacggcgcagccattatacggacagcgtgagaggtctgttgtattctcttgtgatagagattatccggctgaatgaggagcaggaggcaaagcaggaagtgcagggtgtggaaatgcagaaacattcgggagtgacgcagattgcggcggcactcgactatgtgcgcatggaatatatgcacatgatccgggtggaggagctggcgcaggaatgtcatatgagtgagacgcatttcagaaggctgtttgagtcctgtatgaacatgtctccggtggattacatcaatcttgtccggattcagaaggcatgcgatctgttgaaaaagacgacggattcgatggacattgtggcacagaaggtaggctttacgacaacatccacatttaaccggaattttaaaaagtttttaaacacatccccctatcagtggaaaatcaatccggaaaattacgagacaaagcttttaaattacaatatttccgcgcgaaaaggatggtaataaataatggttgaaaatgcgcgttttgtgccgaaaaataagtacaaaatgcgcattttttcgctataatgaacttaacaaacgcaataacagcaatcataaattgggggatgaacagtatgggagaatttttgtttgagagattaagtgatccggaatattacgaggagaaccgcgtggcggcgcactccgaccatgtggcgtaccggaactgggatgaggcggacgtgtggctggatccgctcggaagaaagagcagtttccgcctgtttttagacggatcatggaaattccactatgcgagaaactatgagcagacgatccatggatttgaaaagccggaatacgactgcaggggatgggatgacatccgcgtgccggcacatatccagatggaaggctatgacagtccgcaatatgcgaacacgcagtatccgtgggatggaagggaagacgtctggacggacgagatgccgacgaagttcaatccggtcgcaagttatgtgaaatatttcacattgccggagtcctttttgggagagcgtgtgtttatctcgttccagggagcggagagcggcatggcactctggctgaatggagcgtatgtcggatacagtgaggattcttttacgccgtccgagtttgaactgacgccttatcttaaggacggggagaacaagctggcggtgcaggtattcaagtggacgatcggaagctggtgcgaggatcaggatttcttccggttttccggtattttccgcagcgtctatctctacatgattccaaagacgcatctctgtgacattaagatccgtccacaggtggcggagaatctgtcctgcggcacgctggagctggatcttcgctcctgcggcagcggaagtgtgcgcatacagcttgtggagcgcggaagacttgatctggcggagagccgctatgagacaccggagggcacggaggtgtttgctctggaggagaagatggaaggaaccttacatgtctcgcgggaagtggcggatgtgaagctgtggagcgcggaggagccgtatctgtatgaacttcggatggaggtgtatgacgcggcgggcgctttgcaggaggtcgtcgcgtcgaagatcggcttccgtcggttcgagatgaaggacggactgatgcttttaaacggaaagcggattgtgtttaagggcgtcaaccgccacgaattcagttccctgaccggacgtgtggtgagcatggaggagacgctcaccgacgtcgtgaccatgaagcggaacaatatcaattccatccgtacctgccattatccggacaatatcggactgtatgagctctgcgacatctacggactctacatgattgcagagaataatatggagtcgcacggaagctgggatgcggcggcgatgcgtaagattgccgatccgcggacgattgtgccgggggataatccgaagtgggaggcaagaatgctcgaccgcgtgaattcctgctatcagcgggataagaaccatccggcggtcttaatctggtcctgcggcaatgagtcctacggcggaagtgtgatttatcagatgtccgagaagttcagagagctggatcccgaccgcctggttcactacgagggagtctataacgacagacgctacaacggaagcagcgatatggaaagccagatgtacccgccggtagagcggattgtgaaaaatctggcagagcagaaagagaagccgtttatctgctgtgagtacacgcacgcgatgggcaattcctgcggcgcgatgcacaagtacacagatctgaccgacacagagccgcgctatcagggcggatttatctgggattacatcgatcagtccatcacgaaaaaggatcgctacgggaaggaattccaggcgtacggcggtgacttcttagagcggccgacggactataatttcagcggcaacggcatctgctatgcaaaggggcgcgccgagtcaccgaagatgcaggaagtaaaattcaattaccagaacatcagcgtatcctttaccgaagatggttttacggtaaaaaataaaaacctgtttaccgatacggcagagtatgactgcatccttctgctggagaagaacggcgtggcggcaggccgcagaaaaatagcgctgtctgtggcaccgctctcggaaaagacgtttgttctggaagaactggagggctgcatggctcttgccgatgaactggaacatgcgggaaaggaagccggggcggaatacgcactgaccgtatcgtttgtactgcgcggagaactgctctgggcaaagccggggcatgagatcgcattcggacagaagatttttgcggcaaaatcacctgcaaatggtgggacaatcggcgatgccgcggcagaatatgaaggaaagtgcgtgacgaaccgtaaggcgggacttcagatcatccgcggaaagtggaatctgggggtgaagggagagaattttgacgtactgttttcctacaacagctgcggactggtgtcctaccgctacatgggaaaagagctgattgagaagataccgatgccgaatttctggcgtgcgccgattgacaatgactgcggaagccgcatgcaggggcggatggcgcagtggaagatcgcgagtatgtatgccggcatgagcagcaagggcatgttcgattatgaggaaccggttgtgagagaggcggagaacagcgtctccatcacatatacctacctgcttccgaccacgccgcaggcaaaatgccgcgtgacctacaccgtgacgccggatgcgtatgtgcagaccgagctgacctatgacccggtggaggagctgggcgatatgccggagtttggaatgctttttaagctgaatgcggattacgacagactggagtggtacggacttggaccgcaggagacgtatgcggaccgcagatgcggcgcgaagctcggtgtatataagaaccgcgtggcggataatatggcgcagtatctggtaccgcaggagtgcggcaacaaagtaggcgtgcgctacgcgaaggtgacggatgcaagaggaagaggcatgctctttaccggagacgaactgtcattttccgcactgccttatacaccgcatgaactggaaaatgcaatgcatgcgtatgaactgcctgaggtacattacacggttgtccgtgtggcactggcacagatgggcatcggcggagacgacagctggggagctccggttcatccggaatatcacattgatgtgacaaagccgttagcactgcggttcggtttccgtggaatataaaaaaacagaaaggagagagcgggcatggaatgagatctgtgcccgtgaagaggcatatgaagtttgtaaaaggaatggatctgtccacactgctcgaactggagcggtgtggtgcaaagtattacgataacggggaggagcgggatctccttgcgatcatgaagagctatgacgttgataccatccgtatccgtctgtggaatgatccgtggtcggagaccggcgaatcttacggcgcaggggagaatgatttgaaaacttctcttgagattgcaaagcgtgtgacggcggcagggttcggcgtgcttctcaattttcactatagcgatttctgggcagacccgggcaaacagatcaagccgaaggcatgggcagattacggtgtgaaggagctggagcaggcggtctatgattacaccctggaatccatgcagacattcctggatgccggcgtcaatattaccatggtgcaggtgggaaatgaactttccaacggtctgctctggccggagggaaaagtcccgaactatgacaatattgcgacgttcgtcaatgcgggaattcgtgcggtgcggaaagcggatgcggcgattccggtgatgattcatctggataacggcggaaacaatgcgctgtaccgcgagtggttcgacaattttacaaagcggggggaggatttcgagattatcggactttcctattatccgttctggcacggatcactgcagatgttaaacgacaacatgaatgacattgcagagcgctacggcaaggatctggtgattgccgaggtttccatgggctatacgatggaagactacaagaattacgagaagctttccgatgaagagcgcaagggatatgcgaccagaccggcgcttgtggagaagatcgaatatccgatgacaaagcaggggcagtacgatttcatggaggatttcttgaaccgcatcagccacatcaaaggcggaaaaggaaagggattcttctactgggagccggcatggattccggtaccgggctccggctgggcaacaccggcatccttaaaatacatgaacgatccgggaccatgtggaaacgagtgggcaaatcaggcgctgtttgactacgatggcaacgcactgccgacgcttgcactgatccgtgattttaaaccggaagtataaaaaacggggctgccgcatgaacggagattgtgatcgatggcattgtgaaaaatgataaatgacagatcggaaaaacatgcaactttgttgcatgtttttttgattatgttgcagtttgaaaaaggtctattgcaaaggaacacagagacgttataatagaattacaacaggacggtaacagaaaccattcatagaaaaaatgatgtataaggaggtaacgcatgatctgggaaccagtacttgcaaagtttaaagaattatttggggatgagggagagatcggagtttatttcgcaccgggacgtgtgaatatgatcggtgagcataccgattacaacggaggacatgtatttccatgtgcgctcacgatcggtacctacggtgtggcgagaaaaagagacgacaagaagcttcgcttttattccatgaattttgagaatctcggtgtgctggagtcttccgtggagggcttaaagccggagaaggaagcagactggacgaactacccgaagggtgtgatgtgggcgttcggcgagaagggcatgaaagtggagtccggtatggatctcgtgctgttcggcaatattccgaacggttccggattgtcttcttccgcatcggtggaagtgctgaccggattcatcctgcgtgatatgttcggctttgatgtgacgaatcaggatctggcattgatcggccagtattccgagaacaagttcaacggcgtcaactgcggtattatggatcagttcgccattgcgatgggcaaggcaggacatgcgattttcctggatacggcgaccttaaagtatgagtatgcgccgatcaggctcgagaatgcgaagattgtgatctcctgcagcaacaaaaagcgcggactcggtgattccaaatacaacgagagacgcagtgagtgtgagacagcgcttgccgaactgcagaaagtggtaaagatcaacgcgctcggcgatctgacagaagcgcagtttgagcagtatcaggatgccatcacaagtccggtgtgccaaaagcgtgcaaaacatgccgtatatgagaaccagagaacgatcaaggcggtggaggcactgcagaacaacgatgtcgcgctgttcggaaagctgatgaatgactcccacgtatctttgcgtgatgattacgaggtaacgggaatcgagctggataccctggttgaggaagcatggaagatcgacggtgtgatcggttcccgcatgacgggtgcgggctttggcggatgcacggtcagcatcgtgaaggatgacgcggtggatgcgtttatcgagaaggtcggaaccgcctataagaacaagattggctatgccgcagatttctatgtcgtagagatcggcgacggcccggtaaaattggcgtagtgacagagtatatttagaaacgaggttggatcatgatacaggaaagaatattggaactgacagaatacggactggtgacgggactcatagagccgcaggataagcggtttacgatcaaccgtctgctggagctgtttcacattgacgaactggaggatgaagtcacggcggcttatgagaagcgcacgccgatgacgcaggagagcgccgaggaggcactgccacagatccttgcagagatgctcgattacgcggcggagcagatgctgattccggacaatacgattacataccgcgatctgtttgacacaaagatcatgagcatgctggttccaagaccgagcgaggtggtacgccgtttctatgatctttatgagaaggagtctccgcaggcggcgacggattatttttacaagctgtccagagacacggactatatccgcagataccgcgtgaagaaggatctgaaatggacggcggacacagagtttggaacgctggatatcacgatcaacctgtcgaagccggagaaggatccgaaggcgattgcggcggcgaagctggcaaagcagagcggctatccgaaatgccttctgtgcaaggaaaacgagggatacgcaggacgtatcaaccatccggcgagacagaaccaccgcatcattccggtgaccatcaaccagagcgactggtttttccagtattctccgtacgtttactacaacgagcactgcattgtgttcaacgcaaaccacacaccgatgaagatcgagcgcgctaccttcggaaagctgcttgatttcgtgcagcagttcccgcactattttgtcggttccaatgccgatctgccgatcgtcggaggatccatcttaagccacgatcatttccagggcggtcattatgagttcgccatggcaaaggcaccggtggagcgcgagatcacattcaaaggatatgaggatgtaaaggcaggcattgtaaaatggccgatgtctgtcatccgtatcagcgctacggacaaggatcgtctgatcgatctggcagacaagattctcctcgcatggagaggctacacggacgaggcggcattcgtctacgccgagacagacggcgagccgcacaatacgatcacaccgatcgcaagacggcgcggcgatgcgtatgagctggatctggtactgcgcaacaacattacgacagaggagcatccgctcggtgtatatcatccgcatgcaaagcttcatcatatcaagaaggagaacatcggtctgatcgaggttatgggtctggcagttcttccggcacgcttaaaggatgagatggcggatctggagcaggcgatcttggacggcgttgacatccgtgcggacgagaagctggcgaagcatgcagactgggtggaggaatttcttccaaagtacggctttaccgccggcagcggtctggagggcgagatcacaccggagaggttacatgagatcgttcagacagagatcggtctggtatttaaggaggttctcaccgacgcaggagtctacaagtgcacggaagagggcagagcagccttcatgtgctttgtggatacggtgaacgcatagaaatagagagaggaaaagaacggattacgggacggggattttttccccggaagttgtccgttctttttttcaattcccgataaatgtgttatacttgtgcatggagcaaatttttgcaaatgaccgtttactttcacgtggtaatttggtaaagtaaaggaatgagaaaacgatgcgggtcagaccgcagaaaagaggataggtattatggtatcaaagagaatacaaaaagcgctggagggcaattcggcaatccgcgccatgttcaatgagggcagggagatggctgcaaagtacggggaggagaatgtgtttgacttctcactcggcaatccggcaaccccggcgccgaaggcgttaaacgatgcgatccgtgaccttctggatgaggcggatgcaaagggagcggcaggttctctgggcattcatggttatatggcaaatgcgggctatgaggaagtacgccaggcgatcgcagagaatttgaacgaacgtttcggaacaaagtttacggcgcacaatctggtgatgacagtcggcgccgcaggcgggctcaacattattttcaagacgattcttgacccggatgatgaggttatcgtgtttgcgccgttcttcggagagtatcgccagtacgcggcgaattttgatgcaaagattgtgattgtacagccgaatctggagacgtttcagccggatcttgccgatctggagtcaaagattaccgcgcggacgaaggcgcttatcgtgaatacgccgaacaacccgaccggcgtgatctacaagccgcagacgatggagcagatcggagcgattttagagaaaaagcaggctgaatttggaaccgatatttacctgatctcggacgagccgtaccgggaactcgtgtatgacgggaataaggaggattttctgacaaaatattaccgcaataccctggtgggatattctttttccaaatccctttcccttccgggagagcgtatcggttatgtcgtggtgccggatgaagcggcggacgccgaagagctgatccgcggcattgagatctcaaaccggacgctcggatttgtcaatgcaccgtccctgattcagaaagccgtggcgcgctgccttgcggagaagacggatgttgcattttacgatgagaaccgaagcagactctacgaaggactgacaaagctcggatttacctgcattaagccggagggagcattttatctgtgggtgaagtcgccggtggaaaacgaagaagaatttgtaaacgagggaaagaaatttaatcttttaatggtaaagggaagtgctttcggctgtccggggtttgtgcgtctcgcatattgtgtgtcccatgagaccgtggaacattccctgcctgcatttgcgaagctggcggcagtgtacggactggacaagtaggaggaaaaaggatggagaactgggagtcatatgtgagaaaagtggtgccgtatgtgccgggggagcagccgcaggcggagcggatgatcaagctgaacaccaacgagaatccgtatccgcccgcgccgggggtgcagagggcccttgccggatttaacccggatacgctgcgcctgtatccggaaccgacctgtaaggtgcttgtggatgcgattgcgtcatattatggactgggcagcgatcaggtattcgtcggggtcggttcggatgatgtgctggcgatgatttttctgacattctttaattccggaaagccggttttcttcccggatattacgtattctttttatgatgtgtgggcagatatgctgcgcattccgtatgagacgaaagcgcttgatgatgcgtttgagatccgggtggaggattattacggggaaaacggcggagtgatattcccgaacccgaatgcaccgaccggcattctgatgccgcttgataagatcgaggacatcatcgcgcacaaccgcgacgtgatcgttgtggtggacgaggcgtatattgattttggaggggtgtcggcgctgccgctgattgaaaaatatgacaatcttctgatcgtgcagacattttccaaatcgcgttccatggcgggaatgcgcatcggatatgcgatgggaaatgcgaagctgatccgttatatcaatgacgtgaagtattcgtttaattcttatacgatgaaccggacagcgcttgcacttggtgtggaggcgatccgtgaccgtgcttattttgaggagaccagaaaaaagatcatcgagacgagagagtggacgaaaaaagagctgcgggcgttaggttttacgttcggggattcgatgagcaattttatctttgcttcgcacgagcgcgtgccggcaacagaactgttcgaggcgctgcgcagggagcatatctatgtgcgtcattttaccaaggaacgcatcaacaactacctgcgcatcagcatcggaacgagagaagagatggagacgtttattcggttcctgaaggaatatctgaaagaggcatagccgatgagcggccggccgcctgcagctttcggatgccggaggtaaagacgatcagaccgccgactgtcatggcgatgccgaacaggaaccagaagatcagagaaaacgtcgtgtcgccgaacgggatgagcccggagagcacggttccccagaagttaaacagcatgtgtaaaaggatcgagtaatagatgctgccgccgcggttgcagacatagcctaaaacaagccccagacagaatgcgtagatgccctggatcatgttcatgtggaagatgccaaaaagcagcgcctgcagcagattggctgcccagaaaggcagacatttttttgcctgatgcatggtgacgccgcggaagaccagctcctcgcagaacggggcgaagatgacggagcagacgaccatcagaatggagatctgatcatcgagacctgccgtctcgagcagggattcatatgcatccatccagtgcggaaagagcgccgcgacaaagctcatgatataggtcgtcagatactgtgtgcccggcatcagcatgacgatgcctgcgattgcagcgggatgaaacgtctggcgcagagcggggcggtaattgccgccgtaccggcagtagtaccacagaccgaacacggcgatcgacatggcattgtagattaacagtacgccggtgttgaagcgctgggaactccacagggaaaaggcgtcatctacaatatcgaggaaccccgcgctgccggtgacagagtaccagccgctctcgatcagcagggaaagtcccatggcaaagtaggttgcgagaaactgaatcgcaatcacaagaagcagcgggacaaaaataaacaggaattgttttaatttcttcattattataatctccagttatcgttggtatgaaataaagttcttgcaatttccagatacttctattattataacaatcggatttcatgaatgcaagcagtggaaaaagtgcgtgcatggacagaaacttgggtatttactttaaaactttaatatgctaaaataacaaaagaatccattttgggaagaaggagaagaacatgagtaagaaacttaggacagatgcagtggatcatctttttgacgccatcttgagcttacagaatagagaagagtgctacacattttttgaggatgtatgtacggtaaatgagctgctttctttatcacagcggttcgaggttgccaagatgctgcgtgaccagaagacttatctggatattgcggagaagaccggagcatcgactgctacgatcagtcgtgtcaaccgatccctgaattatggaaatgacggttatgacatggtatttagccgcatgcagaatacggacaagtagtagagacagataaaaagagccacaggagaacgggaacttttgcccgtgcctgtggctttttcgattactttttatttttttctgccttggacttgtccgaggtggtcgtgtcaatgaggcgctcgatgatggtctttttgacatagacatcgtagcttaacatgcagatcagactgaagttccgcagaagctcggcgtcctcaggggcagcatccgggaatgtctgacacgaggtgttgaacttcctggcgaggtctttcatgagattttgtgtctcctgatgctcgagtccgaagacttcacggtagatgtcttccaagctgtagctgccgtcttttccgaaatatttgtccgtgatcggatttaagatgctctggatgtcactgatgcttaggatatttttaaaatagtagatgaaaatcagcgtcagtacgtgctctttggtgtactttttcttctccggcggagggagaagattgttcttggcgtagttgttgatcatcgtcttggtcagaatcttgtcatccgcatgccgtttggatgtctctaactgggaatccataaatgtggtaatctgatccatatataaatcaatgttcggaatatcttccggtctgacataatcaattctctgtaattctgctaacagatcactcagaaatttttttgtatcgttgtccatatgtgtcacctcttatcacattatatagttttcaaaaccagatgacaagagacaaatgttgggaaatgtatatgacagtgtcccagcatgaaaaatagaaaatatgttctgtatggtatcgaaaaacagagagaaatgtgttatactttctcatatcactataaacggaaaaggaaaaacaggcatgagtatttatgatacattaaacgagcagcagaagctcggcgttataaccaccgaaggaccggtgctgattctcgcgggagcgggttccggcaagacgagagtgctgacacaccggacggcatatctgatcgaggaaaagggcgtcaatccatacaatattatggcgatcacgttcaccaacaaggcggctggcgagatgagggagcgaatcgatgcgctggtcggatacggctcggagagcatctgggtgtcgacgtttcactctacctgcgtgcgcatcttaaggagacacattgaccgcatcggatacgacacgaattttacgatctatgattcggatgattccaagagcgtcatgaaggagatctgcaagcgcctgaatatcgataccaagatctacaaggagcgcagccttctggcggcgatctcctctgcaaaggacgagcttgtaagtccgacgcagtttgccctgcaggcggcggcatcgagtgattttgcgaagaaaaagcaggcgcaggtctatcaggagtatcaggcggcgctgcagaagaacaatgcactggattttgacgacctcattgtaaagacggtggagctgctgcagacggatccggaggtgcttgcctactatcaggagcgtttccgctatatcatggtggacgagtatcaggatacgaacacggcgcagtttgaactgatccgtcttctcgcgggcaaatacaaaaatctgtgcgtggtcggtgatgacgatcagtcgatctacaagttccgcggagcgaatatctacaatattttaaactttgaaaagcattttccggatgcggtcaccatcaagctggaacagaattaccgttcgacgcagaacatcctaaacgcggcgaacagtgtgattgcgaacaatgtcggaaggaaagcgaagacgctctggacggcaaacggcgaaggagagaagatcgactttgagcagtttgacactgcctacgaggaggcggattatgtcgcaagggatattgcgtccggtgtccgggaaggaaagtacggttacggcgactatgcggtgctttaccgcacgaatgcgcagtcccgtctgtttgaggagcgttttatcgtgtccaatatcccgtacaagattgtcggcggtgtgaatttctatgcgcgcaaggaggtcaaggatctgctggcgtacttaaagacgatcgacaatgcgagggacgatctggcggtgcgaagaatcatcaatgtaccgaagcgcggaattggtgcgacgacgctaaatcgtgtatccgattatgcggaggcgtacgacatcagtttttacgagtccttaaagcgtgcggaggagataccgtcccttggcaagagtgcagcgaaaatcaagccgtttgtgacgtttattcagacgatgcgcagcaagctgccgtatatcggtgtggcggatctgctcagagaggtgatcgaggagacgggctacgtgaaggagcttgaagcggaaggcaccgacgaggcggaggcgcggatcgagaatatcgatgagttgttaagtaaggtggtcgcctacgaggagggcgaagaacagccgacattaagcggtttcttagaggaggttgcactcgtggcggatattgacagcgtcggcgaggagaacgattatgtggttctcatgacactgcacagcgccaaaggtctggagttcccgaaggtctttctggcgggaatggaggacggtttgttcccgagctatatgtcgatcacgtcagacaatgccagcagtgagctggaggaagaacgcaggctggcctatgtcggcattacacgagcgatgaaggagcttgtcatcacgtcggcgagacagcgtatggtgcgcggcgagacacagtacaacaaggtctcacgctttgtgaaggagattccgccggagcttttaaacggcgagatcaaaaagccggcatatctggaaaacagggagcggcgcacggcggagccggtacggaagaagcggccgacgatgcgggatcagctgtccggtcagagcatgcaggcgagagcgttttcatcggtacatacggaaggcggaagcctaagctacggtgtgggcgaccgtgtgtcccacatgaagttcggagagggaacggtaaaagccatcgtgcccggcggcagagattttgaggtgacggtcgattttgacgcggcgggaaccaagaaaatgtttgcagcgtttgcaaaattaaaaaaagtataaaatgtcttaatttataaattttttataggcgaacagggaaagatatgctataatgtgcgtaataagaagacatgcaataaatgaagataaatcaaggaggggaatctgatgaataagatggaagatctgatcaacatgacaaagttaaacgaacttctgaataagaaggaagaagtggaggagaagaagacctccaaggtagtatggatttttgcaattatcggtattgtagcggctgtagctgcagcgatatacggcatctaccgtttctttacgccggattatcttgaggatttcgaggacgatttcgaggatgattttgatgatgatttcttcgaggacgatgatgaggaagcgccggcaaagtctgaggacaaagaggaaacaaccgaagattaagacaaagggcatggggctgcagagagatgcagccctatttttatgtaacaggaaacgctctgtggggatgcgcacctcgtggtgaggtaaataatgctttgcataccgcatcaggcagtctgccaagacaggcgcaagtgtgcggcaggcgcacactttattctgtagcaggaaacgatatcgtaagtggctgagtcaggcgagtgaatcctgcatgcaggattttttatgtttggcaatgtgcagaagaaactggacggacaatggaggatagaacgtgaaaaagggacagattattgaggggatggtagaatgcgtagagttcccgaacaagggaattgtgagaacggaagacgggggacgcgtgatcgtaaaaaatgcagtcccgggacagaaagtgtccgcatcgattaataaagtgcgcaagggaaaatgcgagggaagactgcttgaggtgctggagcactcgccgaaggagcagccggaggctgcctgtatccatgccggagagtgtggaggctgcacatatcagacgctgccttacgaggagcagcttgccatgaaggcgtcacaggtaaaaaaactgatcgatgacgtcattgtaccggaaaatacagactatgaattccttggaatcaaggcgagcccgagacagcaggagtaccggaataagatggagttttcgttcggcgatgcgtacaaggacggaccgctggcactcggcatgcacaagcgtggcagcttttatgacatcgtggatgtcccggaatgccggattgtagacgatgattttcacacggtgcttacagtgacgctagactattttgaagagcggaatctgccgtattatcacaaactgcgccacaccggatatctgcgtcatcttctggtgcgcaaggcggtaaagacgggggagatcctggtggatctggtaacgacgacacagatagcggaaggggaggaagaggcgcttcttgccggatggaaggatgcgttgtgtgctgccgcctatcagggaacgctcaccggtgtgcttcacacccgcaacgacagtgtggcggacaccgtcaaaaacgagggtacggatgtgcttttggggcaggatcatttctatgaagaactgttaggacttcgttttcagattacaccgttctcctttttccagacgaactctctgggcgcggaggtgctctatgagacggcgcgggagttcatcggggatgccctgccgagcggaacggatgcggatgtcgcggagcatggaaaagtcgtgtttgacctttattccggaaccggtacgatcgcgcagatgctcgccccagttgcaaaaaaggtgatcggcgtggagattattccggaggcggtcgaagctgcgaaggagaatgcaaagttaaacagtcttacaaactgcgagtttatcgcgggagatgtgctcaaggtgattgatgagatcgaggagaagccggactatatcgtgctcgatccgccgcgtgacggcatccatccgaaagccctggagaaaatcatccgctacggtgtgccgcagatggtgtatatctcctgcaaaccgaccagcctggcgagagaccttgaggtgctgcaggcgagggggtatgaggtgaagaaggtatgctgcgtggatatgttcccggcgactgtgcatatagagacaatagttgcactacatcggatagattcgtaaaaatccttgattttaggcactttgagaggtttttcaggtttgatcagagtgaccgtaaaacatacaaaaaggcaatttctgatggagtaaacgtgtctgtggtattggactgcggcttcggaaacacatcaaaggaaaagtaatatttttatcattcaacagaataaaagaaacgtgaaagaccgttcattttcaagaaaaattgaaagtgagtggtcttttttatacctttaaaacggatttttattaagacgttttgaagggctgattcgatgtgttcgagaaaggcgatattatggagacgatccggaatgtagatgtaaacagattgcatgatttcaaaaatcatccatttaaagtagagatgaatacagaattgtgcgagcttatgagaagtattgaaaaagaaggagtgcttgtgccacttcttgtaaggactaatccatacggtgatggatatgaagttatatcaggacatagaaggaaggaggcagcaatttgggcaggagagacgaaggttccggttgtgataagagaattagatgatgatcaggcagttgtggcaatggttgattctaatctgcatagagagaatctcaaacctagcgagaaagcatttgcgtataagatgaagctggatgcaatgaaacatcagggaaagcaccttgacagtggggctttggctcaagttggaccaaagtttacagatggaagtcagctaaatgagaagggcaataatacaagtacaataaatagtaatgaattacttgcaagacaggtgggagagagtgtggcacagataaaacgatatataaggcttacaaagcttatcccaaagatacttgatatggttgatgatgggaagattgcattcacgattgcagtagaactgtcttatctgtcggagaatgagcagtatgagcttcatgcagtcatggatttagagcagtgcacaccatcattgtcgcaggcaaacaggatgaaacgtataagtcagagcggaaagctggatatggatgcaatctattcaatattggaagaggaaaaaccgaaccagcgggaacagattaagatttgtgccagtacacttgaggagtatttcccagatgattttactccaaagcaaaaggtggaacttatagagaggctcgtaaaagagtggcatgaaaaacagattaaagataatggaaggaacaggtgattatatgaataaaaatcagaatatacgatttaatatggataaggaatctgatattatggcatgggagagccttcacagcaaagatgtgggggaaagatttaagtcacaaaacaggttcgtgattgaagcaatcaattattattatgagagagttatgcgtatacaggaagatccatatctggaaacaagggaaaaagaagatgcatttgcggacaggatagttggaaaggtagaaaggaaagtactttccaatcttcctgccttactgggattatatgtaaagaaagattatgaggaggaataattatggcgatagacaggacagttaagtttacagtgagattaaatatgcttaatccggctcatgtaactattaataaggttctgaatgagttaaatttggatatatttaagtcaaagaatcagttttttatagatgcagcaacttattatatcgagaattatgggcaggaagaattaacgcagccaaagaaagagaaagagccggagtttgtatcaacagaagatatggaagcaattgaggaaagaatcaggcaggcggcaaaggaagaagcacgtcaggaagccaataaggaagttatgataatggtaggaagtctgctggctgcaattcagactggtggaggtgctatgtcagtaatgaataaagctgatgctgctatggagacaggaacgaaaagcatatctgatgaggagtcagaggattatgaagaagatgagacattagtacagagtgcactaagatggatgataaatgattagcaatagaatatagattatagagacagggactgtgtagaaatacatggtccttatttttatctgcaaatattgtagcgactgccggcataaaacgatggcagaaataaaaagcgactgaacaatccgacggcagtaacttaaaatgccgtaataatccgacagcatggaacttgaacgaaagaaagtcggaaaaagaacaaaggaaaagtgatggcacaaagcgacggcattatataagagcgacggcataaagtgaagtcagctatgaaaaatgctgtaacaaattgccgtcaattaatgtgaaaagacacctttacgagattttagataattatcagagcaagagatgcttcaagcaaggggcaagagaagttcaaatacagccctcggcgtttgagagcgaaatacaccctccgcacaaaacttcgttttgtactccggggatttcgcgattgcatcgagcctgagaataaatattactatggctgcatttgaagaattaaatgtagctgataaaaagaaggagatgatagcaatgccaagacattcatttatacagatgacgaaactccataatgtcatggggagaattgattatataacaagtacagttaaacaggaaaatctatatgccatatatgcgacacagccacttcgttctttttggaaagatcttgcaaaatgcaacagagaagaatttgctaaaagtggaacgataggaaaatatattgaggcaagagagctgattatagcattaccggaaggcttgtatcattatgagcatgattatcttatcaaacattttgctacggatttcaagaaaaagtatggtgtggactgctatgcagccctgcatcataacaaaagaaagacaaactttcatattcatctgatatttgcagagaggacgaaactggaaaagccggttgttaaggtagcatcaagaaacatgttctatgatgaaagagggaaacatgtgcgtactaagaaagagatattggatgcaagtggtgacatccgtaatggctgtaagattatcagaaaaggcgaggtctatgagaaaaaagagttttctataaaagtcgatagatttaaaaaggattcatttcttgatgaggcaaaggtgttttttacaaatgaaataaatcagcttgtgctgcatgaagaggataaacttaaagtctttgataagaacagtccatatcttgctactaaaaaaataggcaaaaataatccaatggaagaacaaataaaggctgacaatgaggtacgacaggaatggaacaggactgttgacagagcaattgtaagcggagtgtcagaagaggacatatcaaggataaagaagaatgaaataacagaaaaggtaaggtattccatagatttatatggagacagaccggatcttcttgcaagtattataaagcttgctattgcagtgcttgaacttcttattaatcgcattatgctggctgcggttggtgtggcagaaaagatgctggatattgtgtcagaagaaagtagaaatattgaggctaagacttatccaacaatgccaacaatgtcaccacttgcaaaaaaatacctaagtcttcagaatatctatgatgaattacaaaagcaaaatgaagcaatatttgcgcaggagcataaacgcagcgagctggagatagaattgtcagaatgtaatggtgcatttaaggcacgaaagcgtggagggttgcagaatcaaatatatgaactgaacaaacagattgataatatgaaacgctatttgtcatctattgtgcaacgacatggttatgataatgtaagggatttttatagtacttattatgcggccaaaggtgaatatgctgattatgtgaaagatgttgaggaatggaatgttaatcacgttaaaaagaatgagaatattccaactgaagagaataggacagatagatatcagattggcgaggaaagggataaaaacagatatatggatagaaactatgtagagaagaaaagataaaagaagatagaatattgggtgatggagtgaaatccctcacccttttttgtgttgataaatgtagaactagttaatcaataatcataacattattttgcttgcaagtgttccgataaaagaatatacttatagtagactaattgtatcgtttggagggaaatcatggattacataacaacggtagaaatgtcaaaaaaatgggggatttcatcaagaagaatttcccttttgtgtagtcagggcagagtgcctggtgcagagaaaaaagggaaaacatggctgttaccaaaggatgcggtaaagccgactgatcctcgtaagaagaattagatgacgtattggaggtgaaaggcacttatgggaagaccagaagattccagagtaaagattccggcacttgtacattttacaaggcttggatatacctatatgtcaattaaagataaagaacgtaacatagactatgatggtgatactaacattttttatagtcagtttttgtctgcaattaatagaattaatcaaacagaattaacacttgcggatgcaaagaaaattatcggagaactaaagattaaattagataatgatgatcttggaaaatcattttttcagatattgcaatcagatattaatggaataaagttgattgattttaatgatataagcggaacacagaatgactatacagtagtaactgaattaccatatgaaaatggtgatgataattttcgcccagatattgttgtgctggttaatggaatgccattatcatttatagaggtcaagcgtcataataaccgtgagggaattctgacagaacgaagtcgtatggagagaaggtttggaaataagatttatcgacggtttgttggaatgactcagtttacagtgttttctaataataatgaatatgatgactctgatattgaaccaattcaaggagctttttatgcttccagcagctataaaagaatgttttttagcaagtttcgtgagcagagagcagaggaattaggggcaaaaatgcaagcaattaatccagaggaggaagcttttattttaagtgatacaaatctgatttctattaaaggaactccagagtatgcttcttccttatcggaaaactcgcctacaaatcgtatcattacatctttatatacaaaagaaagattattgtttttattaaagtatggaatatgttataaaaccacaaccaacaaagatggtattacagagatagagaagcatattatgcgatatcctcagttgtttgcaacattggcaattcgagataaattgagagaaggagttagaaaaggtgtaatttggcacacgcagggaagcggaaaaacagcacttgcatattccaatgtaagattcttgaccgactattttagtaaagaggaggggaagattgccaagttttactttatagtggatcgtttagatttagcagagcaagcgaagaatgaatttgaagctagaggtcttaaagtaaaattgataaaagataaggaagagtttattgcagatattacaaatcccggagagtcaaataccagtgggaaagtgacaatgactgtaatcaatattcaaaagttttccaaggattctgttactaaaccatctgactataatgtggatgtacagagagtttacttcttggatgaggcacataggagttataatccaacaggatcatttctggcaaatcttatggcatctgatagagatgcggtgcagatagcgcttacaggtactcctcttattggagatggatacaatacaaaagatgtatttggcaattatattcataaatattattataatcagtcaattgcagatggttacacattaaagctgattcgcgaggaaattgaaacgacttataagaatcagatgaatgatacacttaatcaaatagtaagacagggaagcatagcaaagaaaaatttatatgctcatcctaaatttgtagaaaagatggttgattatatcattcatgattttggggaaggcaggacagcattagattctactatcggagcaatgattgtttgtgattcttcggaacaggcaagggaagtggacaggcagttaaatcgtttttcagattatacacatgcactggtacttcatgatgaaggcacaaagcaggatagaaaaaacgatcaggaagagtttaagaaaggcaatatagatattttggtggtctataacatgcttttgaccggctttgatgctcctcgattaaaaaagcagtatttggcacgaatgattaaagcacataatctgcttcaaacgttaactagagtaaatcgcccctataaaggttatcattatggatatgttgttgattttgcaaatatcaaagatgagtttgataaaacaaataaagcatattttgatgaacttcaatctgaacttggagatgaggtacaaaactatagtaatatttttaagagcaaagaagatattgaaaaagatctgaatgttgtaaaaaatcagctttttctatatgatacaagcaatgtggtaagttttattaatcaaattagcgagattgatgataagaagcagttacttgatttacgacaagcattagaaaattataaggcgatgtataatctgatccgtttgtatgggtatgaggatttatacgaacatttcaatgtcgagaatgcaattaagtgtctgaatgaggtcaataatcgaattagcattattaacttaaaaaatagcattgattcatcagaggatatgtcacaggtactcaatatggcattggatcagatagatttccagtttcgcaagataaaagaagaagaacttatcattgctgatgcatttagagatagcctggaaaaaacaagaagagaaatcgtagacagatgccttgatccaaaagatccagaatacattgcacttcttgatgaattaaagcgggtattcaagaagaaaaatattgaggaactcacaacagatgaaatgaagcagatgatgggggaactggatactttgaaaaagaaggcagaaaaaagaaatctggcagatcgtatgcttgcggcaaagtattcaggtgatgttaaatacatgagaactcataagagaattatgggtagtccaccacccattgcagatgcaattactgtacatagaattttaatgagtgttaagtctaaggcagatgatcagattgctcataatgagaatatccttgataatgaggattattttattaaatcgttacagccaattattttgagagcatgtatgggagaaaatgttagaatagacaaacctcaacttatgtttatagataattgcctgtcgaaagaatatatattagaaagggattgggtttcctgatgacaacagaagcaataatagcaaatacaaaacagatgatagatgatcttaagacagtatgtaccaattttggacttggtaatgctagtagtgaatataagattataacagagatttttttgtataagtttttaaatgataagtttatctatgaggtacagcaggcggatgaagagttaaaaaattccgagaatgtggagcaggcattaaatattatgtcagaagatgactatgaaatgcttatgatgcttctaccaccggctactgcaaaactcaagagagagcattttatatcttatcttttcaatcataagaatgatgagaagtttaacgaattatttgattcaaccttatgggatatttctaacactaatctagatgtgttctctgtaagtactggctccggtgataagattcgtctatttgatcagaatttatctcaaaatgtaacagagtcaaatcggaggtctgatttctgcaaagctatgattgataaattagttacattcagttttgcagaggctttttcacagaaatatgacttttttgcgactatttttgagtatctgattaaggattataacaaggattttggcaagtatgcagaatattatacaccacattctattgcaagtattattgcaagaattatggtgccggaaggtgtgcagaatgtaaccgtatatgatccggcagcaggttctggaactctggtacttgcacttgcacatgaaattggcgaaagtaattgtacgatttatacacaggatatttctcaaaagtctaatgaatttttgagactcaatcttattttaaataacttggtacattcacttggtcatgtagtgcatggagatacacttctttctccacagcatttgaaccgtcagaaaaatggtttgatgaaatttgattatattgttagcaatcctccatttaatgtggatttttctgataacagagatactcttgcgggagatatttataaagaaagattttgggctggagtgcctaatgtaccaaataagaacaaggatagcatggcaatctatcagatgttcttacagcacattattttttccatgaaagagaatggtggcagagcagccgtagtagttccaacaggatttctaacagcaggaactagaatccctaagaaaatacgagaacgcattgttgaagacagaatgctcagaggtgttgtctcaatgccaagcaatatttttgctacgacaggaacaaatgtatctgtgttatttttagacaattcaaagaagtatgagcaggcaatcttaatggatgcatctaaacttggaacaaagattaaggtagatggaaaaaaccaaagaacggttttatcaccagaagaaatagagaatattatcgatacctttaataactttgaaacaaaggatgatttttctgtggttgtagattatgacaagatagagcagaaaaaatgttcattcagcgcaggacagtattttgaagtaaagattgaatatgttgagctgacacaagaagagtttcagaaaaaaatggatggatatacagaaaaattaacggaattgtttgctgagggaaatgcactgcagacagaaattttggaacagttaaagaaggtgaaatatgagtaggattacaaaatatgctttatctgatttatatgagatgagttccggaatttcatctacaaaagaacaggctggacatggtgcaccatttgtatcttttagcacggtctttaataattattttttgccagatgagttatttgatttgatggatacaaatgagaaagaacaggagatatattcgataaaagcaggagatgtccttattacacgaacaagtgaaacaatagacgaactagctatgagttgtgtagcagtaaaggattatccaaaagcaacttatagtggatttacaaaacgccttagacctaagaaagaaggaatagcatatcccaagtacatggcattttattttagaagtgaattgtttcgtaaagctgtaactaataatgcctttatgactttgagagcaagttttaatgaggatatttttacgtttttggatgtttacttgccaatttatgaagaacaggtaagaattggggatatgctttatgctgttgagtgcaaaattcaaaaaaataaggagataaatgattatttagagcagcaactccagctgttgtatgattattggttcactcaatataattttcctaacgaggacggacaaccatacaaggcttcaaatgggctaatggtatggaataaaatgattaatcatctaattccagccgattggaaagttaagccactggggacaatatgctcttttcgtaacggtattaactacgacaaaaatgttgatggtaataccatatataaaattattaatgtacgaaacatttcatcttctacgctttttcttgacgaaagcaattttgatgagatatgtcttccaaagcaacaaggtgataaatactatgtatctgatgatagcattatcattgcccgtagtgggataccaggagctacaagaatattatgcaatccaagtagtaatataattttttgtggatttattatttgttgtacaccatctgataataccttacaaaactacttaacattatatttaagacaatttgaaggtagttccgcaactcaaaccggtggttccattttgaagaatgtaagtcaagaaactctgaaaaatttgattgtgcctattccaccacaatcactgttaaatcagttcaatgattcaatattacctatatataatcttatcaatagcaacaccaaagaaaatgtgcagcttatcactctcagagactggcttcttccaatgttaatgaatggtcagaccaccatcgaagattgatatgataaataatcatttataatataaaaaataactcttgaaagtggcgagagcaaatacaagaactccacttcatggtggttctcacatataaaggagaaacacatgaaagagaaaataatatcagagatcataagagagatgatttcgtcactaaataatgaacaattaagcaagttgaagactacattggagatatatctttataatgtttccattgaagccaaacaagaagctgatacagagaaaaaagaagtggattatttggaagtatttctttctgcaaaaaggattgaaggttgttcagaaaaaacactgatatactataaaaatacaatacagcaaatgcttgatagtattggaaaatcagtttgtacaattgttacagaagacctaagaacttatttggcggaatatcagaaggagaaacaatcaagcaaggtaacaattgataatattagaaggatattttcaagttttttttcttggttggaggatgaggattatattattaaaagtccagttcgcagaatacatagaattaaggctgctagtactataaaggaaacgtacacagatgaacaattagaatctatgagagataactgcgataatccaagagacttagcgctgattgatattttggcttcaacaggaatgcgtgtgggtgaactggtgctactgaacagagatgatatttcttttgatgaaagagaatgtattgtgtttggtaaaggagataaggaacgcatggtatattttgatgccagaacgaagatacatttgcagaattatcttgattcaaggacagataataatgaggcattgtttgtatcacttaaagcaccatacaatcgaatgaaaataggtgggatagaactgagacttcgagaaatgggaaagcgattgaatatagagaaagttcatcctcataagtttagaagaacactggcaacagtagccattgataaggggatgccaatagaacaattacaaaaattattaggacatcaacgaatagatacaacattgcaatatgcaatggtcaagcagagtaatgttaagattgctcatagaaaatatattggataggagaaatgtctttatgaaaattaaggatataggacgtgtagtaacaggaaaaactccattaactggtgtgaatgaatattatggaggaaatataatgtttatttcaccttctgatttacacggtgattacttgatagaaaagtctgaaaaaactataactgaggagggattgaaatcaatagaatcaaattccattgatggaataagtgtgcttacaggatgtataggatgggatatgggaaatgttgctatgtgtaatagtaggtgtgcgacaaaccaacagattaatgcaataatagattttaatcataaattggttgatccaagatatgtttattattggttaaaagggaaaaaagattatttattttcaattgcatctgttaccagaacaccaatacttagtaagagtgtttttgagaatatagatattcctcttccaagtttgaaaatacaagaaagagttaccaagttactctcacttattgatgagaaaatcagaaaaaatcaccagataaatgattatttagcacctcaatcttcgatggttgcttgaccattcatcaagattggaagaagccagtctctggtttgcactagaatgttattttccttttgaagttgtatgattttggtgtccataggttcaatctgattaatgaattgtgtacggatttctttgggaatattcaaaatgttataactgttcaaattggcttgattaattttcagttgtattgaaccggtttttatcattgatacaggtatatttttcaatagtagatataataaacggcaggagtaaccattcacaggttgtaaaacatgcgtatgattattaatccatacatcaccagatattcgttgtaatattggatttccattgtcatccatcacagaaccgtcttctgctaaaagtacaaaatctcctgaaaaaatcggacgattaacataatccattatcccagttgcaccataataaggaattgtacctttcatttcctcacgttgatgactagaaagtggaattctatcagaatcaaggcattttgtaatattcccgacggatgtatattcccaattttgaggaatatttcgatttagttccttgcaaaatatcattttacccccagaagatttgtatggatttccgttttcatcaggaaaatcaaattgcacaaaccaatagtcatagatggtctttgccatctcttctaaataatcatttatcagagaaataattattatgatatgggctatcatattacaagaatattggatattatttaataaataacaaaatatgcaaagaaaaggaagacacataatgttttacgatacattaaatacagaggaacaagtttcatacttaataaagccaatcatagaagtgctacaagaagccggggggcaattggagagagcagaaattagggatagaattagcgaaaaagacgagaagattgctgaatttgaacaaaagctatatacatctaataaaaccggttctaaatataagaaatttgattttaagtttaattttgctcttaaagagttaagttatttgggattccttacatatgttagatataaaccacttgtgacattaacggaaaaaggagccgctgttgatgtttcaaattttgatgttaagaaggaggttcgagaaaaggcagctgtttattgggaagaaaaatcagctaagaataaagagaagaatagtgtaatgccaaaagaaatcgaagatgaaaacagtataaatgctgatgatatattggatgatgttaaggtcaaattgcaaagtgcaatagcaaatatgtctcctaagaaatttgaacaattctcgagagcattactgactaaaatgggagtacagtttacggataagggtattaaaatatcgaatgatggtggaattgatggatatggatatcatacagacgatgatgatttcagaacaaccagagttgtaattcaatgtaaacgatataacacagctcctgtgagtgagcctgatataaatcagtttttgggggctatgaataaatttcaggcagattatggagtgtttattacaaatagcagatttactaatgcagcaagggaggcagcaagagaaggtacaccaataacgttaattgatggcaatgatctggtaaggcttgttattaagtatgaactttatattacacctgtaacaacatatgtacttgatgacttttatgatgaagaatagttacgtcggttatattaatagaaaacatggtgtaacttctctcactgattgtacgtcatgcaactattttttatagcacataattttttcccatttttcaggaaaacccattttggaaaatagcagctcctggctgatgtgtgggcagttcttgcgaacggaatgaatcaattgtttgagctcagctttaaattgtttaaattcctgattgtcaataagataacgcaaagcaatcactactgcgaatagatccttctttccaatagcatattgtccttttttccgtggtagttgtaatttgctatgtaaaacagtatcagggattgcttcatttacttgaaatgaataaagtctctcgttgtgagcacatacattcctacagcttgcgaggatacggatgagctgatgcaactgaacctctgacatattggcaaaattcagactaaccttggtgcggatatcagaagtcgtatattgatacatttttgaaatttgtccaaacgtaagcgcattggttgctacccataaagggacatttccatacattgttgcatgatgagtgatataactatagttgcttggcaaggcgatagttttacttaaggtagtaatcaggcgatttattttgctttgatttctgcgagtatagttataattacctgcagttaaatatgccgtctgttgttctccatatttttcgcaaaagtagtaggaaagcatggatttcaactgtctttccacatgtaagatatattttagaaagagcgttcttaattcttcgtcaaagtaatagaaagcggtaatttcttcaaaagtaacaccatgtagataattaccggatggtttatgtttaaataaatccttataaccgccgattaatgaaaaatagcctaacttttgtaaagtggttttggcaaattcaggatcggaaataacaagctgtttttctttttcaagcttttcgatttgctcatcatatgtgaaaaatgttttattagccatttctgaatcctcctttattttggcataaaaaaagtggagtccacgcatggaactccaccggctgcgggcatcgcaagtttccgcagcgcaaccactaaagatactataccattgatatctggcgatgtcaaacagtattttttagtggcattaatagtttatgcgtttctgtgtgtgatattcttattttgttcattcttggcattcagccatttttctttatattccagtgctttctcaggcttgtgccatctggcatatagattattcagatatccgtatacagatttcagatagttattcttagaaacataattatcaaatgctgaaacagcagtatcagatgaagctaaatcagaatcactggtatccatagcagcattgataatactctctgctgccagtagattcttttcggcttctactggtttaccttcctttaatgcaattattccggaagcaagtcggcagcagccataatctaaagtgttgtagccttcgttatctgttacaagagcatcatattgattaaggacaagccgtgcaagctctaaatcaccagcaagtatcagcatatttacaagattaagcatctgttggagcatatcatgcgtttcaattatgccggtgtcagcatatgaaatccttatctcaaatgccttgtgtaaggcttcggttgctttatcagtttttttaagtgcaagatatacattggacagattgttataaagatttgagagtagattgatatagcgcttctgattcatggtgttcatagtgtcatcttcattttcaagcaggtgtatagctttttcacgtttctttacagccacatcataatcctttctaatgtatgaaagctctgctttgtagtctaaaagtaatgctctgtcacagacagaatcgatatgctcctgttccataaggtatgatatccggtcagccagttttgacatataatccctgacagagtatttttcaagatatggaaacatatcctgaaggaatagcagataacaggcagaattatcattgatgatgttttctacaacacttatcatagcctgtatcgtattatcgggctttcggacttctaagccatgcatcaagcagattgagtgaagactgtttacaagtgtctgacaattggaaatgcaaggatttaattcctcatatatgatttcctgtatcagaggatgcaggtttattttcttattctctatgtcatctgttataaaaccatatcgggcaagataattaacatcatgtaaagaggcgagctgcagccagttcctgaaatgattcttatacacgccggataccggaaggattgacaggttcttaagtatatcggtttgagaagagttaagccggctgatctgcataagaatacgcaaatgttcaatcataagcccatcataataatccccatctttatataattccacattttcactatctgtgatattaagcccacactgctttaattcatgcagtaattcatcaggctcaagaccgcctgctgcaagtgaaagagctgataatacgacagtcagggtgtgggaatgaacttctcttattatctgtttaactgtttcagtatcatcatccgaataaggacaatgcgaagcaaaaagctgtaaaaggtctttttcagatgctatctctttaatcttaatcgaagcatattgttttacttcacagcgtgtcgtgacaagcaattcaaaatcattctttacaaattctttgaaaaaagcatcatccttaggaagtgcattaaagttatccagtatcacaaggctgtcctgatgcagggagcgtagcagtcggtaatgtgagtcaaatagagcatcctcatccatatctgatgtatcatctgaaaattccatggctgcaatgtcttttcgcaggctgccggaataaaacaggtagatgatattggtatatttctttttattcctgctggcataatattttgccagttcactttttcctattcctgcgattccatttatgaaaacaacggattcagaagcaagcagtctgccacattcttttatctcatcatttcttccgatgaattcttttacaacagccggcaaacgattacttagcagaatgtcagtaagctccggtgaatacaggttctttctgttatggtcagataatatggcgtaaagcataacatctgtaaaaaatgtggcattatcatcaatggcaattaattcatcagctttggtaatgccaattatttttcggctgttattaatcatatcttccaacaagtatctggtattagaaacatttataagattaggaataatcttgttcttaaagtccgtaatcatctgattacgcccggtatcatttttgtattcattcagaatatctacaggaacaggtcttgctccattacaccagcggctgaaggtgatgttatcatctgaagcttcaccatagtcagaggcttcatccaacaggcagagcgaaaacaggtcacgcacaagccggtgctgtgggtaagtctttattttattgtcaagtaatgcacctgtcacatgtgcaaatgtcaattgatttttcatactttctccatgtctatgtcaacttccagtcaacatgtcgtcaatgtgtttcattctcaaaatttactatcattatcacaacaaaacatagccagcagacagcagaagatatctgaaatggctataaatattataacatagaacaaacatatgttctacaacttttttgcacattgaaaactaaatgagctttatcatatgccaacagaaccagcgaagatgtttccggtaggaaacggagcgggtgaagacacttccgtcaagggtgggaaacggactcgaacaggagtagcccacaggtcacgaagcgattcgggggactaaaggtcagctgtgagactgacaacatgtgatatgcagaaagccaaatgaagtatctttcaacggtatgattatcacaattgagatttcggtaaaagaaggtgatatgtttagtattttaagaagggggtgtttacacatggcaaaagaattagaattagccaagaaactggctgtacttgggtggattttccgcaagggactgattaccgaagatgagtacagtagaacaagagttcatattatgagtgaatatgatgttataacttttatgacagcatagccgcacattcgttaacatttatattttgaattatagtgtaggcagtagcagaaatgatgttactgccaatttattttatacagacagattttagggaaggagcgttttctatggatgaaaaacaggtagaagtaataaagaaagtggatggtcctgttatcagagaccgcagaaagatgggaaagccacttactattacaagaaaaagagtagcagcatatgtccgtgtcagcacgaatggagaagagcagatacagagctttaattcacagaagcagtactatcaggataagatagattccaataaagagtgggttatggttgggatatacgctgatgagggtatcacaggaaccaaaacaacgaaaagagagcagtttcttaagatgattgatgattgtatgaatggtcttatagatattgtaattacgaagtcagtatcaagattttcacgaaatcttgttgatacactgcaatataccagaatgctgaaggtaaagggagttacagtaatttttgaaaaagagaatattgacacatcaaagatggaaagtgagatgcagttatcacttttatctgctcttgcacagaatgaggttgagtctttatcccagaatgtgacaatgggtgtgcagatgaaaatgtccagaggagagctgatgggatttaacggatgtctcggatatgattataacccggaggataagagtataactatcaatgaagcagaagcagagacagttcgcctgatttatgatttgtatctgcagggatatggtgcatatagaattgcgaaggagcttacgaggcttggtaaggtcaataaaaagggcaatgttaagtggacagacagcggtgttaggggaattcttaagaatgaaaagtacaagggcgatttgcttatgggaaaaacttacacagtagacccgatatcaaagaggcgtctggataatcacggtgaatccaataaatattatacgaagaatcatcatgaagccattatttcagaggaagagtgggataaagttcaggatattttaaaaagcagatatcgtactaatgaaaatgtatcagatgcggagagaatcaagtttgcaagaaaatacgcttttagcagtatgtgtcagtgtggtttctgtggaactaatctcaccagacgttcccataatcaggatacaaagcataaaaagccggtatggaaatgccggacggcaacgaataagggaattgcaaactgcccacatagcaaagccgtagatgaagtggttatcgaaaatgcgtttcttgagatgtttaagttgcttgcagagaattttgatgatgtacttgaatctgtgttgtcatcagtggaagaaacattatccaaagacgacagtacagaaaaattgaagcgtattgagaaagagattccctcgcttgaaaagaagagaaaaaaattgactgatatgtatctggatgataaaatttctaaagaagcctatgacgataaatacagtgagattagcaataagttggataaatgtgaagaagaaaagcatttattttctgactgcgtattatcacagaagaatattgctgataagatgaaactcatcaggcagaagcttaaaggggctgatgtacttgatgaatttgacagagtagtatttgaaagcattgtggagaaagtcgttgtcggtgatatggaagaggatggcaaagctgatccgtataagctgacatttgtgctaaagggtatggatgacagaagtataccatatgccagagaccgatatatgaatctttgtgaaaaggctgtgtagacaacaaggaggagcttaaaaatgagcgataatcatgacttgttgaatgataaagatgtgtgttcttttgaagaacacgaggcagaaaatgtgtgttccaacaaagatgccgttgcatgttgagacggttgtactgctttcccacaaaaagccagacggacatatcaacgtaaaagttgagtttggcgaaggtgagggaaaagttccgcttgataatatcgctaaaagagccgaagagtacaagcccaaggaacgagtgacctacaaaatgataaaggagtacatagaagctaaatacggcttcaaagtacataccgcatatatcgcagaggtaaagagagatttaggattgccgatgtatgatgctcctaatgcggtagaagaattgaaacagccgaggaagcatccgacagcggagaaagtggaagcgataaaggatgcattgaaatattttggcgtatgtagctaatttttagtgcatagttataaaatttataaaacgacatttaccgttctatatggtaagattaaatatagtaacgattttataaatgtaggtggtaaacatgggagataatcgaaggatttttagtgataatgaaaaaatggtattatttaatgaggtcgatgggcgatgtccaatttgtggaaagccattaactaataccaagaatggacaaattattaaaatgtttgaagtggcacatatatatcctgcgaatcctcgtccagaggaagtcgaattgttaaaagacgaggaacgtttgagtaaagacgttaatagtctggctaatgtcatagcggtctgtagaatatgtcataaaaaatttgatacaccacgaactatagaagaatatcgctcgtgggtaagacttaaaaagaaattgttgcaagatgcacagctaaaaaatacatatgcactttttaatatagaggaagaaataaaggaaatattaaagaatttaaatgatgaatctttagaggaagacttggtacggttaagttatgaatctttgaagatagagcaaaaagccaacgacaccttaccttttgcaataaaacgtaccattaaaaacgatgtggtagattattttgactatattcataagatatttattgaaatggacaaagtaacaccatataaatttgataccctggcggctcaaataaagggattctattgcaaaactatgcaaattaatcctaaccaagaattcgtatatgcttctttagtggattggcttaatgaaaagacagggtcatattcaagaagggcttgtgaaattgtgattgcatattttatacaagattgtgaggtgttttcatgatattgccgaataagctaataagctttcaagattgtattctggcaaaaacggtttatattttagaaaagattagtgattcagatttttcagtaattgggttatacgaacaagtggaaactcattttgaagatttaaatgaatatatgttggctctggacgttctatatgttcttggcaaaataaaatataatgaggggttgcaggtgatacagtatgttgaaaaaaattagttgtaatatatttttgcagaaagaaattgtatttcatgagggtttaaatgccattgtaggagatgatattgcttctaattcgataggaaaatcaactatgcttatgattattgactttgtttttggaggcgatgattatataagtaaaaatcatgatgtagtagataatttgggtcatcatgatttcagatttatttttaattttgataataaggattactattttattagaagtacaaatgaatacaaatttgtatctatttgtaatgagaaatttgaaattttacagagtgtaacaacggaagaatttaccgcatggttgcaagaaaagtatgattgtcaattagaatcgttaacatttagaaatattgttggtagatatttcagaatttatgggaaggaaaatttaaatgaaagaaaacctatccagtattttgaaaaagaaacagcacctaaatctatattagctcttttaaaattgtttgataaatataaatcattaaaagcatatgaggagcaaatagaaaaattaaaaagtgacaaaactacattggttgatgcagcaaaaaagaattttttgccgaatgtcaacacaaaaagtttatttaataaaaatgaaaaaaagattgaagaattaagcgtacgattagaaaaaataaagaaggaaattgtaacaacatcgcttgatttagaatcaatggtttctcaagaaatattaaaacttaagagggagaaaagccaacttactattaaattaaactcatatcaaagcagattgctaagaacacaaaataatataaagaataaacctgtgaaaattagtgctgagttagaacaatttgtgtattattttccagattttaatgtagaacaggttaataaggtggaggatttccataaaaatataaataaaatattaaagagtgaacttgtagcagtagagaaggaattaaaagctaaaatcgaggaaattaataatcagataatagaaatagataaggaaattgaacagaaattgtccataaaagatgcacctaaattagcagtagatgaagtggttgatttggtggcacaaataaaacagcttaatgatgaaaatggatactataccaagaagaaacaattggaggggactatatcacaggctaatgatgatttaagtgaattaaaagaaaaggcattagatgaaatatgtaatgaaataaatgtcaaaatgtacgagctaaataaagaaatatatgttgatggaaggcgagcaccgacactgaatattcacggaagtaaatattcgtttaatactgcgggggatactggaacaggtacagcttttgctaacttgatatcatttgatctttcattgctggaattaacccgtttgccggctatagctcatgatttgccattgttaaaaaacattgaaaatgttgcaatggaaaacattatttcaatatatagtagaagtgaaaagcaaatattcgttgctattgataaattgagttcttatgatgagaaagcggcacaaattataaataaacataaagtattacaactttcgaaagacaaattactctttatcaaaaattggaaaagcaataaataaatctaaaaagcgtatcgttagaaataatggtacgcttattttttgcccctttttgcagatttgtcctttctcatgctttccaatataatgaagctaaagaagtggaggtgtgcttatgagagagaaatttaatcatctgtatttggatagccacgaaagaaaacttttgatacatagccttgtagagttaaaaaatcagcgcatacagcaaggcagatatacggattgtgttgacaagcttatttttaaggtcataaatacaccgaccaagagaatgaaaattgaatatgtctaaggcaaattacaaagctgcttattcttattgattttaagagtaggcggcttttttgcgttctctggtactgtttacatagctaccttgacaaagtggctaaatctatgtgaaaggaggacgcatctatgtcaaattgcaaagtgattgctctgactaaccagaaaggcggtgtcggaaaaacaaccacagcggttaatctgggtgtaagtctggtgcagcagggtaaaaaagtcctgctgattgatgccgatgcacaggcaaatcttacgatggctctgggttataacagaccagacaatattcccataacgctttctactgtaatgcagaacatcatagacgataaaacgcttgatgtttcacagggtattatccaccacagagagggcgttgacctgcttccgtcaaacattgagctgtcgggctttgaggtaaggctaattaatgcaatgagccgtgagcgtgtgctgaaaacctatgtcaatgaggttaaaaagaattacgattatgtgcttattgattgtatgccgagcttaggtatgataaccatcaatgctctggcggcggctgacagtgtaattatcccgacacagccccactatctctctgctaaaggtctggagtttttgcttcgctccgtatcaatggtcaagcggcaaatcaacccaaagctgcggatagacggtatcttaatgactatggtaatgccccgtaccaacatttctaaggaaattacggcaacggtcaaaagtgcatacggtcagaaaatcaaggtgtttgataccgagataccacattctatccgtgcggtggaagctaccgcagaaggcaaaagtatttttgcttacgacaaaagcggcaaggttgccgtagcctatgagcagttaggaaaggaggtggcagagattggcgagaagcagagaagggttgacaaggctcttgccattagtgttgcacttaaaaaaatatgaaaaaagtgtaaagcaggtatgagggatagatttgcacattggtaaaatggcggctgtatttctataatttagaggtacagccgttttaactttagcggaggtattcgtttatgggaaatgaaaatttaattcaaaatacagaactacaaaacgaacagttgaaagatgaaaccgaaacattcaattcttttatcaatgttatggtgcaaatagttgaaaaatatggaaagaccgttttgcaggaattggattgtgctgcgtaggttacgcagccttacatatcacatttccctataaatttatggaggtggtacgatgaacagagaaggaaagaaatgtgttctatatccgagagtaagtactgaaatgcaggtggacggatatagccttgaagggcagaagaatagcctgaaacgatttgctgacagagaggaaatggagattgttggtatatatgaagatgcaggtaaatcgggaaaatctattgaggggagacctgcttttaagaagatgctttctgatataaagaacggattggagatagattatattctggtttataaactttcacgatttggaagaaatgcggcagatattctaaattcattggagtttgtgcagtcgtatggaataaatctcatttgtattgaggaaggtattgactcatcacagacaagcggaaagcttttaatttctgtattatctgcggttgcagaaattgaaagagaaaatatcattgaacagacaatgaacggacgcagagaaaaagcaagacagggaggttggaatggcggttttgctccgtatggatattatctgaaagacaatcagctcttaatagaagaaaccgaagctgaagcaattcgaattatatttgataagtttgccaattcagacatagggcttggcggagtcgcaaaatatcttaatttgcaaggaataaaaaagataccccgtcagaatggaacattagaaacttggagcagccatttcatacggttgatattagataatcctgtctattgtggcaagattgcttatggcaggagaacacgagaaaaggtaaaaggcacaaaaaatgaatataagcaggttcatacagatgattatattctggaagatggacaacacgaaggaatagttagcgaagaattatggcaaaaagcttacacaaaacgtatggcaacaggaattaagcagccgtccaaaataggtaaggacaggtcgcatctgttgacgggaatattaaagtgtcctatttgtggaagctcaatgtatacgaataaacatgcgtggacgaataaagatggcacatacaaagaagtttactattatatctgcggtaggaacaagcaggagcgagggcatcattgtgattacaaggcatcgcttagaaaaacagacattgaaccacttgtaattgaagctgttaaagaattggtaagtgataaatattttgcaaaagagatagaaaagcgtattggcgtacagactgataccactgctattgataaggaacttgccaattatgagagcaagctgaaagaagtagatttgaataaagcccgtctggagcgagagattgataatctgcctattgatgctcgtttcagagaaagaaaaatccacgacatgacattaaggcttgatggattgtatgatacgattgtcgagttggaagaacggattgaagatgcaaagctgagaagaagttctatcgaaatggaagcaattactatggacaatatttacaagcttatgctgaatttcggaaagctctatgatataataagtgacgaggaaaagaaaagccttataacttatctaataaaggaaattcagatatatcctaatggagagtcagagatgcctttgaagtcgatagagtttaatttcccgatatatcgtgatggacaagaggtaaggcggctcttgtgggaaaaaggtaataccgttgagtcggtggttctgatgcagtattgtgggaaatgagaaaaataggcatgttaaaccacaagatgttgtggtttgagggcaaaaattggaacgaaaaatgaccagtttttgccctatttttttccccgtttttatagatgcataggtgcaaaaaagagatttttgggtgatttgagcaaaaaagagaggaggaaataaaagtaaatagcagatgaatatgtgaggcggtacttattttagagatgaaataggtactgccttttttattttcaaaagaacaggaggaagaaaaatgtcaggattgctttggataaaggacctgagtaaagagatacttttgacagtaaatatttgaaaatgtttttttatttatactcaaaagaattagttgcatcactatatgaaagcagtgatttttagagatataaagttatgttttagtatatttgacaaggtaaaaaaattatgtaaaataattacttggaagtgtgaaaacatataacttggagaaatggagaagtaggaatggcaacaataaaagaaattgcagagattgtaggtgtctctagtgcagcagtttccagagtgctgaattatgatgaaggaatatcggtcagtgatgagacaagggatgcaattttttcaacagcagaaaaacttggatataaaaaaagagttatttatcctaaaatcgaaaatgtcgccttattatactttacagataataaggatgaactggaggatgatttttatcgtggggtcagagaagagattatcaaacaggcaaagaagatgaatattcagttaagcatttatgaccgtaatgacggaatggatgcgattccgaaggatttgaatgcttttattgcagttggctggcttgccaggaaagaaattaataagctctataagatatgtaaaaaaggtgtatttattggaacttcgccggatgaaaaactgtttgatgcggtaaagccgaacatggattcatttgtgacgcagatggttgattattttattgaaaaaggacataaatctattggttttattggaggaagtgaccgaaacattgatacggggaaaccggctatggatatcagggaatggtcttttcgacaaagcacagcttattacggttgtctgaatgaagattatattctgatttcagagaagtttacggtagatgacggatatcgtatgggaaaggagttgttaaaaaagaaagcattaccgacggcactctgtattgcaagcgacacattggcggtcggagtgctgcaggcattgaatgaagagggagttttggttccagagcagatggcaatattcagcatcaatgatttaaatatagcaaaatacatgtctccaccacttacgaccattcatatagatattccctgtatttgcgagacagcattggatttgctgaggaatcgggtgctgtatgggggcagagtgacgaaattggtttttgtgaatggaattccgatttttcgaaagagttgttagaataaaagagatgccagaaaacatggcatctttttttgtttctgtaaatggataatatgcacaaaaatagaatgcaaaaattgttaatatagtgcaaaataatatgtctctattgaaatttgtgtgtaagaatgatacaatctgaacaagtaaataatttacctaaaaataagtaaataattgattgagaaaagaaaaggagaaagcttatgaagaagagaatggcaggaatgctcttggtagcagggatgatggcatcactggtaggttgtggaggggctgatgcagctaagactgcaaccgcagatgcgaatggaaactatttggtaaacggtagttttgaggaagcagattttaccggatggacggtaacaaacattgatgacgttacagaggaactggatgtgtatgaccgtgaaacagactgttttgaaggtgtacagtctttacatttttattcgggaagcagcaatgtgaatttttcagcagaacagacagtaagcggattggaggacggttcttataaactaactgcacacattcagggagaggctgcaggtgatgaaaatgcgcaggcatatttttatgcgattgttgatggcgaagaagtgaaggtcgatggtgagctgaatggatatgtaaactggtacacggcagagctttccgggattacgccgacagatggaaaaattacggtaggtattcgtgtttcaacagctccgggtggctggggaaccattgatgatttgacacttgtgaaggagtaaagaatggaatttataaaaggcatggacatttccatgattaaggaattggagcatagtggagcgacatatcggctgaatgaaaaagaggaagatctgtttcatctactgaaagagtgtggaactaatatggtacgaatccgaatatggccagatccctatgatgagaaaggaaattcctatggaggtggtggaaatgatctgcagacgactattggaatcgcaaaaagaacggtggaaagtggaatggattttatgctggacttccattatagtgatttttgggcagatcccgcaaaacagataaaaccaaaagcgtggaggaaattaacgggtgaagcactcgaaactgcggtatatttgcataccgttgatacattaaaggcactgaaaaatcgaaaactcgttccgtcaatggtgcaggttggaaatgagattacgaaaggactgctttggccagatggatatgtagaccggtcggaaagcatggcaggacttctttgggcaggcatcaaaggagtgagggaggaatgcccagaagctaaaatagtactgcatcttgattttggaacggacaacgagatgtaccggcaatggtttgatcggattgctccctacagattggattatgatgtgataggaatgtcgtattatccgcactggaacggaagcttaaataagcttttagacaatatggatgatatcagcagcaggtatgataaggatgtgctggtggcagagacatccataggctatacaacggaaacgtttggctgtaacggtattgtgtattccaaggaacatgcggagatgaccgggtatccggcaacacaggaaggacaagaagcttttttaagagatttatttgcaactgtaagaaaagtaaagggtgcaaggggaatcggtgtcttttactgggaaccggcatggctgccagtagaaggctgcacatgggcgagcaaaagcggaagcatatatatgaaagagacagaaacagcaggaaatgcaatggcgaatatggcgttgtttgatgaaaaggggaatgcgaacagtgcattagtaaatatgaaaacaatgtaggaggaaaagttcatgaagaaaaaaatcatgttatcgatgcttgtggtactcacgacagcaggaatgctgtcaggatgcggcaatctgggaacagcagattccaaactcgttatttggacaaatatgagcgtggaagtggataccatacaacaatatgcagatgaatggggagaacagaacggttatgaggtagaagtaatccatcagtcaccgtcagtccagcagtttgcgcaggcagtaaaaagttcttcgggaccggatgcagttgtgggaattccaaatgatcagcttgcagattatgtgaatgcaggtcttacggcagaagtgccacagaatttatatacggatagtgatttttcggatgcagccattcaggcatgttatgtagatggaaaaaggtatgcagctccgctctcggtagagacaacagcattattttataatacagatatggtttcagaaattccggcaacatgggaggaattagtagagcaggcggttgacaacggcggcgtccagtttgatgctaccagcatttattatgatcttgggtttgtgagagcatgcggtggatatatctttgattataaagacggcgcatatgatacaagcgatattggtcttgcaaatgaaggatctgtggaagcatatgggtttatcaatgacttgtgcaaccaatataatctgcttacagcagatgttacagctgatattgcaagaagcaatttccaaaatggaaaatgtgcttattatattggcggaccgtgggatattgatggctttacttctgcaggaacaccgtttgcgatttctgagatgccgactttcaatggtcagccctttgtgacaccggtaggaactcaggtaagttttgtaagcaacagcagtaacaatcaggagcaggcatggaattttatccagtacttaattgaaaatggcgcattgggtatgtatgaatccggagacagaataccggcaaagcttgcagaccagcaattggatgaaatacaaagtaacgaatacacacaggcatttatcgcacagattcagaacggtgagccaatgccgactgtttcagaaatggggcagctttggacaattcatacgaataacatcaggtctatgtgggcaggggaacaaacaccgcaggaggcgacggataatatggttacccagctgaaagaagcaattgaattgatgaattcgggaaagtagtgatggtatgaaaaagaaaaagaatggtatggcatatgcttatttggcaccggcactgatatctatactgttggtaacatgcttgccgattatctatacggtaattttgtcttttacaaactataatatgtatcatttgaatgattacagctttgtcggactggtaaattacttgaccgtattttcggggagcataaagaatgtgttttttccagtgcttggatggacgatatgctttgccgtattcagtacggcaggctcctatacaatgggacttattcttgcaattctgttgaacaacccgcatatgaaggagtcaaaaatttatcgggcgattcttatcgttccctgggcactgccgtctaccatcgcaatcttagcatggcagggattgttaaatgagcagtacggaggtattaataatcttctccatgcaatcgggattgcatggaatataccgtggttgacgaatgcattatgggcgagagtaggactgatcattgtaaatgtatggcttggatttccctatatgatgaatgtttgtcttggaggattacaggcaataggggcagaatactatgaggcagcgaaaatggatggagcttcaaaatttcagtgttttaagagcattacgttgccgatggtgacaaaattgtctattccgttggtgatttcctcatttgcagctaattttaataattttggaaatatctatatgattacgcagggtggaccggcaagggttgataatcagtttgcaggatatacggatattcttgcaagtacgacatataaaatgacaacatggtcgaaccgatatgaactgtctgctacgtttagtgtgctgatttttattattgtcggtacttttacgctgattaatatgcatttatctggtgcatttaaggaggttgattaacatgaaatataaagagaaaatgacagcctctgaaatgagaaccctgtggggtagcagaattgtaatctggattacgatacttgttgtgatgtttccggttgcatggattgtaatgtcttcgttttcagcaggagatagcttttttctgtcctcactttttccagagaaattcagtgtggagcattatgtgacactgtttcgggaaaccgattttacaatttgggtattgaattcattaaaattttgcttcatagttgcgatcattcaattaattcttacttccttggcagcgtatgcatttgccaggcttcggtttgttggaagaaagtatggattaatgtccctgcttgtgctacaggtgtttccgaacagtatggcagtggcaggctattatatcttaatctatcagttcggattggttgacaacagtattgcacttattctggtgctggcaggtggaagtgcctataatatctggttgctgaaatcatatattgacggactcccggtagaactggatgaagctgccatggtggatggagcgaatcagtttcaggtattctataaaatcattataccgcttgcaatgccgcagttggcagtcatatttttattttcgttcattgcgacttacagcgaatatgtgattacatccatctttttgcagacaccggggaagatgacactggcattggggctgcagtcattcatcagcgatcagtttgcggcacactggacactgttttctgccgcggcagttatttcatcactgccgattatgattgtattcatgtgtctgcagaggttcattcagaatggattggttgctggaggcgttaaaggataacattacaatttttagtgagaaaggaagctaatatacctattgctccatcaatatacagcttatgcaacaagatggataattccttactggctgtaagggatattaaccataaatacattgtagtagaaaggagattctatgagaaaaaacaaatttttatcagttatggcagttgcgcttgcagcagtacagcttataagcgcatcgacagttacggtgcaggcatcaaccctcacgggggcggttgagacagatgattttataaggggagtagatgtgtcaacgttggatatgttggaagatttgggtgcacagtattatcagaataatgttgcgaatgatgctttgacaatcttacataataatggggcaaattatgtaagattgaaattatgggtagatccctatgatgaagacggaaatgcatatggtggtggaaacaatgattatgacacaacactggcacttgcaaaacgagcccaaaatttgggaatgaatattctgattgattttcatttaagtgatttttgggctgacccggcaaatcagattaaaccgaaagcatgggaggacttatcatattcggaattgaaagaaacattgtattcatatatgaaaacaactttgaataattttgcatcagagggaattgttcctgattatggtacaggttggaaatgaaatatcttccggaatccttcatgaagatggagaaattggaacagatgaggatttttccggactggcaggacttttgcagtcggcaatttcaggtgtcagggattcatctgcttcaaatacaaagattgtgcttcatttggatcagggtggaaagaatgaattgtatacatggttttttggcggattattggaagaagcacccaatcttgattttgatgtgttcggactatcatattatccgatgtggcacggaacaatggaagggttgcaatataatttaaactatcttgcaacaacatatgataaagaagtatgtgttgtagaaactgcatatgcatggaccacggaagatggcgatggtgtaggaaatgtttttatcagcggagatgaagaaaccggcggatacccggcaacagtggaaggacagtttcagtttatgaatgatttagagtcggttatattgaatgttccgaatgataaaggcattggatatttttattgggagccggaatgggttccggtggaaggcggtacatatgcttcttcagcgggagttgcatataagaacgatactgttacgccaagtaatacatgggataatatgacgctttttaactttaatggaaatgctttggaatctattaaggttttgaatcagccaagtgaaaatctgctgacaaacatcaactttgagcagaatgaagtaacaacttcaccgagtggatggaatgtgtggctgagcgatacaactgattcgaatacggtcaagacagaatatggaagcgcttatgacggtaattataaattaacattttgggatgatgcggattattcctgctcgatatataaaacatttacaaacattccaaatggaacttatcaattctctgtttgggcgatgactaacggggatcaggatgttttgcagctttatgctaaaaattatggtggagatgaacttaataccacgatagaaacaagtgatattaactggaatattttcagtatagatgaaattgttgtgacaaacaatacattggaaataggtgtttattccgttgctggtgctgatgactggtgtaacctggatatggctatattaagaaaagtagagtaaaactattgtattttttgctgcgaagaagaaaaaggaagaaacataataattaagacataaataaaaaagaaggaaacctgctgataccgcagtgtgttggcaggttttcaaaaaatgacagaatgttgagatgagtgatgaatcggggggtttattactctcttttcatgttagagagaaagttgcgacgcgacataattacagacgcgatacaatctgtttgcggacgctttgcgttgctatcattaacgtaaagcgaggtgaacagcatgaatatggagaaaaacagaaaaaagagttaaacatacggatcgggcaaaggttgaaaactgttagggaaaacagtggatatacacaggaaacatttggaatatcgttttgataatattgatttggattaaaaaaatgtgtatgagtttatgcaggcaatttttaatttttgtgatgggtgtgattgtgaatttgaagcagttgcagattgggaatctgatatgatgcaggaaatggcacagtatcaggattggtattaagggagaatgatgatggcagagaagattagaaaacttgcgaattcagaagttgaagtgttatctagaatagttgcagaatgcatgacaggaagccaaatgaacgaaatttttcgggaatgcggagtcagggacacaagcaatgaaagtacaaaatggaaaagaatctactacacttttttaacgagacaagaaatagacggagcatcaaatgcttttcttaattttattaaaaagagcttaaaaccggtaaggttcattaacggtcaaaatggtgattatgatgagattttattagagataaataaaccattgatgttaatcgggctacagatgacaaatgagagaaagctgttaaagatagaggcagcaaccacaatatcggaggtcgaaagacggacaagagatttggtaagcgagttacaaaaaagacatattcatcaggatgtaataaagtgctgtaaagaagaatacttacaggagaactattttcatgcaatctttgaagctgcaaagagtttgtcagagaaggtaagagaaaagacagggatgcaggatgacgactccaatttatttaataatgcttttgtagttaataatcccagactggcaataaattcattgcagacaccttcggaaaggaatgcacaaaatgggttaaaagagatgttaaacggaattacacatatggtaaggaatgtgacggcacatgaactgaagataaagtggattgtgaatgagcaggacgcaattgatattttgacaacaatttcctttttacataaatagttggacgagtgttttgttgttccacagcatataatataattaggaaaaaacaattgttgtgagcattaggatatgctatactaggaatgagaagaaagggtgtgattgtatgttggcaacgaaaccgcaggtagtagcagaaacatcagatactgcaaaattggaattatatagattgattggtgaaggctataaagcaatgcaggaaggcagaaccagtacgattgatgaagtgagagaaaaactgaagaagaggagagaagagcgtggctaatgtagtatttaccgaaccggcagaatatgatttgctggatatagagtactatatttttgtcgatctttgtaatcctcaagcatcaagaagaataacggaaggtattctcgaagctgcagaaaggctgggagaatatccgatagggcatcctttagtagatgatgaacttttgggaagaataggtttgcggatgacgcgctttgataattacaatatcttttaccattatgacagcgaggatgatgtagtgtacataatcagaattttatataacaaagttgattggcagaatatattgaaaaagtaaacgaaaattgttggaatcaaacctctaagtcttcaaagatttggaggttttttcttcctgttttcgctggaaaataatttccgaaatagacagtctatggtacaattattgtgaaaaacaacagagaaggtgccaatatgggatacgatgcatatgtgcatataaagaagaaatacactaagttagccattgaaaaactattgatgctgatggattatgaaaaaagaggggattctttttattgtggtaatgatgatgactataagttttttactggtgttcatgtctggttgtgcgacgaaaatgaggaagaatgggtatacagagttagaagtcagtactttgcagtaggatatgatctgcagaagatgaatgaaacgattaggtgtctaaaacaatattgtgatgcctcgtttgaaagtgattatgggaagaatagatattttccagaggctactcttatcaaaggtgcagaaagcggatgctattttgcagtggagaggttatttaataatttcagcagtttaaagcatactttgagtaagtatcctagtgatgtagaagcagagaaatcaatgtatgaaataagtggaattcccactccaaacatgtttaatgcaaatgtgtattcgacttatttatgttctttaattgaagaatatttcagaacaacatacattgcattgctgaaatattctgaccggaaagaaaaaatattaaatgttaaattttcaccatatgatatggtggatataagtaatggagagaagaccgtagaagaagtttttgcaagtacattatcatttcagaatatacaaaaaatttgttcaaattttcatgctttagataataagctagatataggacaagcattgaagaaaccttatcataatagaaaaaagaatctgtatgaacaggtcaatgatattttggagcgaagacatggtctaatacatcgactggaaatagatgatagctattgtactgaaagcttacaaaaagatatacaggatgtgattgttgcaattagaagggtatactcttatctttgtaaatattataactgggaggaacaagaagtgagtttgtaagacagttattttcataaaaaagaattacaaggttttggttgtgtatactggaaattgaggtgtaaaagtgaaagcatttatgtcttataataatttagctattaataatgcgaatttcaatctggaagggaaattagcaacattatggtttgataatttgctgttaggaacaggcaaagagcttgttgagaaggttatggaagatgtagcagaaaaggaacaatggagtagtgatacttttaaggaaatgaagaaggtacaaatatcttcagaaaccctacttccttcgattagttttatggacgaatcaataattgaagatgattattttaaagatgctgctgatgttttgaaggataaatatgcaaaggaattatcaagtcctaaaacttacggtggcgccatgcatgaaatagtatgggaaggttttggaatagcgaattctgttaaatattggaccttgcttaatgcaaaagcgaattgtacttttttgccaatggatatggaacagcagatgttgggaaaagtttttggaagtacaacagatatgggatatagtaattttagcgatattattacagcaataatacctgatatttctgagtactcatgggatgaaattatagagataaggcatcacaactattggacacagtttagaaaaaaacttacagagttgagtgaaagcattgaagacaaaaagctaggacaagatattctggaggaaatagtaagaaaagatttaattgaaatggcacaacgttttagacctcaagtgactaagaatattgtaaaaggggttgtgagtaatattccattgccaattccaattaatccagtatcagtggtgtgtacaggatatgatataatgaaggagatagattttgataaaaaatatggatggatatatttttatttggacaataagaagtagaaaaaaattagataatgaataagtacaagactattgtctcagttactagtaagtgagaaaacaaatggttggaatcaagcctctaagtcacatatgatttgggagctttcttctgcccattttgattttggaaaatctatccgaaaaaaaactatggtacaattacaggtagcaatgtgtgccatagaaaagagcagacttcaaatcaaaccgaagccaatcaaagtctcgtctatgaaatcaattctaatcttttctgtggcaggtgcatcaaggtgcagtatgccgtttgtgcagacccgatatgggatcattgcatcatttttgaatccaaggcttaacggaaagccaagggttgtgcatctaaattgcacgctcagataataatgttgaaatactcaatttatcttcattttcattaaaagaaaaaattgataagctaattagtaatgaaggtagattatatattgggcaagatatgttagttggaccgaatggttacgatttttctggtaaaggaaccttaaatgtaatgggagcaaataagcaaccatatcgaaatgttgcagttccaatgcaaggaacatcgacaggtaatgctaaagaacttgtgggttatttttggaaacattttggtgaaacggattgggttgctgtaagtaatgggggaggttactgcagatggcagggattaaatgatagtgtagtcaaatggggaaaggaaggagagtacattaagtctcaaaaggggtctgcgttaagaaatgtaaaatattttggtgatactcaaatgctatttagtgatacaggaacagcagggttaaatgttagagttttgctggataatcagatttttattgcgtctggtccaggaattagagttgttgaaggaaacgaatatgcacatttagctttcttgaattcaagaatagcggcatattatgtgagaatgatgtctccaaaacttacaatagcgggcggatatattggacaaattcctgttaatgataatatttattcttcagttgttcttgaaaaagaagcacggttatgtgttgagctaaaaaggaaaatgttatcgacaagacctaataatatagagtatgagtccacatatatacaaaatattagtggtaacttgcttaatgatgcttgcctaagaaggaaatgctacacatactagcattatttaattcagtagtatttgattatattgtaagattaaaaatggcggggcttgatttgacgcagacaattattaaacagattcctattccggatacaaaatcatttgaaaaagagttggtctatatgggagaaaaagcaacaattgaaaagcatattaattctcgaataagaatgttatacgcaagcaaccaaagactggataacttatttgcggatgtgagtatctagccgataaagagaaaaatttctagaaaacaaataatagcagaaatagatagattagtagcactcttgtatggattaaatgaagaaacatttgagaacatacttcatacttttagtaagtactattcagaaaaggaagttgaagcttatttttaggcatcaacgggagcatcccaaagtttgtgtaaacctccaaactgatgtaagataaaattactcagtttgcatgcctgtaaggagaaaaagatggatgtaatggttttgatcgattcgtttaaggggagtatgacttccatggaagcggggaatgcggcgcgtgacggggtgttgcgcgtctatccgcatgccaatgtgacggtccgccccctggcagacggaggagagggcacaacagatgccctgatagaggggctgggcggaaggaaagtggaactgtctgtgacgggaccgatgggaagccgggtaaaagcttactacggaatccttgcggatgaaaagacggtggttatggagatggcgcaggccgcgggcattacgcttgtggaggaagcgcagagaaatccgggaaaagccaccacctatggagtgggcgagatgatacgggatgccgtttcgcgcggataccgcaaattcatcatcggaatcggcggaagcgcaacaaatgacggcggaatcggaatgcttagagcgctcggtgtgaagtttctgaccaaagatggagaggaagcaggagagggagcggatgcgcttggtaaaatacatttcgtttcactggagcatctgatgccggaactgaaagaatgtgattttcagattgcatgtgatgtcacgaatccgctctgcggagaaaaaggggcgacctatatttatggaaagcagaagggcatacgggaagaggaaatgccgcgtatcgacgcggatatgaagcattacgccgcgatcactgccgagcggatcggcgttgactatgcagcccgggagggcgcgggggcagccggcggcatgggatatgcctttatcagttatcttggggcgagactggttccgggaatcgagctgatattagacgtgatccattttgaggaggaggcaaagaaagcgcagattgtgctcaccggagagggacggctggatcttcagactgcaatgggaaaagcgcccgtgggggttgcgagggctgccaagaagtatggctgtaaagtgattgcgttcgccggttcggtcacaaaagaagcaactgcgtgcaatgacaacggcatcgacgcatttttcccgatcgtgcgcggggtgtgcacgttagaggaggccatgcagcgggaaaaagccatggagaatcttactgattccgtggaacaggtatttcgtctgctataatatcaactactctacaggatgatttagaagaacgattatctcaaaaatctggaatgaaagagcaggtgatacgggaaatagatctggataaacggttcaaaaagaaatgttggggcaatcaggttctcccctcaccccttacagtgctccccgcggtatgccgtcggtgacatgccggtctccttctgaaagctggagaaaaagaaactgcggctgccgaaggacagttcatcgctgatgtcctgaatactcatgcgggtacccgatagaagaagctttgcttcttctattttttttcggcggatataagcattcacgctctcgccggtcacttccttgaacttgtgggaaaaataatattccgtgtagccgagccgttcggagagcagagagatcgagagcggttcgcggatgtgcagactgatgtagtcgcagatgttctgaatctgcctggaatgtgcattcgtctcctttgcggcgcggacacggtggacgtaatcatcgagaaattcgcggcttaaattggtcgtgtcggcagtcgttttacattcctcgatgcgcccggcatagtaatcgtttagggtgtatgcgatggagggattcagaccgccatcgatcgcagcgcggctgcacagggttaggagcaccagcagattatttttgctcatgcggagtgaatcgccgatctcggccttgacgccggagcttaaggtcatggattttgcaagagcctttttgtattccggatttccctcgcggatcatggagagaaatgtctgttccgccatccagatgcccggatgctccccggagagaagcggcgagtcatccggaacgcttgtcgtgctgtgtgaggtaaaagagatcagatccgcggtgatccgctcgccggtaatggcgcagtgaaacatgatggcgtaggagagcagcacggaagacggaatgatcggcacactctcgatctgctttacaattttagagcgcagcttgacggtaagctggtaggaatccagctttttacgcagaaccagatgcgagttgcttccggtaaaagcaggaccgacgatgtggatctgctgcagcgcaaagccctgatactcaaaaccggcgatccagagaagtccgaactcggtgtccaaaatcagcggcatgcggttcccggattcgatatgtgcgagtacgagagaggaaaaacccagcatggagataatgtccggcagcatgagttctgccggacagtctgtctcgatcagctcaaactccgggctgtagtgccagagatgaagcgggtattcacattgaaccatttcctgaaaaaaagagagacgttctttgatgtccatgtgggtattcctttctttagcggttccagcttccgaggaaacgcaggctttccttcggatgtcttgtctgtgtgctgcggtcgaccgcaatcagtccaaaagtcatcgagtagcctttctgccattcaaaattatcaaggagactccagtgaaaataactttttaccgggagaccatcgcggatgcaggcagcgacgccgttaagtgcggcatcgataaaagcgacgcgcctggtgtcatcggaagttgcaattccgttttcagtgacatacaggtcaccgtgaaaatcttctgccaccctgcgcagaacatgctctaaagcttccgggtaaaactcataattcatctgggtcagttcggcaccctccggattcggaagctgaccgtccggaccgatcagggagcgggtataattctgcacgcctaagaaatcatcctccttaatataagggagatagtgtaaaaattcttcatcccactcagaggctgcgcgcgcctcgccgcccgcctgcggctgaatgtcgtgcaggcttaaggtcagaccgactttaatgtccggatagagcgctttgatttcttttctggcgagctcatgtgctttcatgatgagaagatcgccctctctggtgcgcatggaggtaaagttttctactttttccacgccgaagacttccatattttcaagggcggttgccttttgattttccatcattttctcaagattgatgccgacctgcaccgtaccgtccgcgctgtcgccgctccttggcgctgtctgtgctgcctgcatctgcgccatcatctgccgcttgtagcgctcggcgattgcggcgacctgaatgcccatatttgcctcgttgatggtgcatacatagtgcagttcgctgccgagttcttccataatataatgaacatagcgggcaaagtcggcaggcgtagtcgaagcttcccatccgcctttggtcatcagccatttcgggctggaaaaatgatgcagggtaacaaacggttccacaccgtattttttgcagcaggcgatgacgtcgtggtaatatgcgacggcccctgcatcaaacacgccctcctccggctcgatgcgcgcccattcgatcgaaaaacgataggcgtttaagccggcgtcggacagaagcttaatatcttcctcatagcggtggtagtgatcgaccgcgtctaaggacggctccaaaaagctggtgtgcttcatgtgctccatcgcccataagtcgctgcggatgttgttcccttctacctgatgggcggctgtggcagccccgatcaaaaaatgttccggtaatctcataaaatcctccattctgcagtgaaaaaatacagcgtcagccgtatttttcctgtgcatctcttgtaatctgatgttactatataagattttataaaacccggagtttacaaaatcgtgaaaatgttagaaaaatagcaatacatcattttataacatgaattttagtacataacaacgaatttgtaaacacagaaaggaaaaagaccggctagaataaagccatagaaaacagaggccgcagatatagcagacatacggaagcggcaaaatacggaaaagtctggagggtataaaaatgtttggaaagaaaaaagaacagtctgtggagacaaacggcattgtctaccgccgtgcaaagacatggagggtagcgcttgcaggatgcagttctgggattggaatgtgtttttatgtgctgcttggactggcaagctatgtggcaaacgaagggtatggcattgcaacagcggtggtaggcattatcctgactgcaacaagaatcttggacggcgtcacagatccgatcattgcgatcatcatcgataagatgaacacgcggtttggaaagatcaggattctgatggtggcaggatggctgatcgagtcactggcagtcctgatcatgtactgctgggcgagtggaaagggacatggaatcgtgctgttcgtgctgctctactgcctgtatgtgatcggctatacgatgtgcaacgtcacagcgcagatcgttccggcgatgcttacgaacgacccgaagcagcgcccgatggtaggcgtctggagtacagcttataactatctggtgccgatgattcttaacatcgtgattacggtgatattgctcccaaaatatggaaatgtctattcggtagagatgcttgcagcatcctgcatcgtctgcgtggcagtatcgggtgtgggattacttctctgcagcatcgcggtatcggatatcgataaaccggaaaattttgtgggcgtggcgagcaagaagaaggcggagccggtaaaagtaaaagatatgtgggagctggtcaaatccaaccgtgcgttgcagacgttcatcgttgcggcaagttcggataagatcgcgagccagacggcaagccaggcggttgtgacgacgatgctgttcggaattattatcggcaatatgcagcttgggacaatcttaagtgtaatcggtatgcttccttcgatcatcttcgcgtttatcggggcgaaatacgcaggaaagcacggaaataaagaggcgatggtgacgtggacgtatgtgtgcatcaccgtggcggcggtgcttgtggtattgtttattttcattgatccgaccctgattgcgacgacgcttcctatgatgattgtatatgtattattgaccctggtgttaaatggtgcaaaaatgtgcgtgacgatgtcaagcaatgcgatgatggcggacatcattgattacgagttagaccgcagtggtaaattcattccggcagcagtgacaggtacatacagctttattgacaagttagtatcctcgttttctgcagcgattgcaaccggtctggtggcattgatcggctacaggcacacgatgccacagccgaccgacccgtccacaccggcaatcttctggatgacgatgagcatgtatttcggactcccgctgattggctgggtatgtacgctctgcgcaatgcgcgagacgccgctctccaaagagaagatggaggaagtacagaagagcattcaggagaaaaaacaggcagaagtggaaaaagtgattgaggaaatgaaatagagagaagaaaagagagggaaaacggaatagatgagaaatacaatagtgctggaaaaagactggacattttataaaaatccacagagtgaaagcggggaagcggtgacgctcccgcacacctggaacgcggttgacgggcaggacggcggaaacgattattatcgcggaacctgcaaatatgtgcgtcattttgcaaaaccggaactggaaaagggaggaagagcgtatctggaatttaacggcgcagcgatgacggcggatgttgtggtcaacggaacgaagctgttccaccacgagggcggattttctacattccgggtagatgtgacggagcagttgacagaggacaatctgttagaagtatatgtggataactctgacaacacaaaggtgtatccgcagaaagccgattttactttttacggcgggctgtaccgcatggtaaagctggtgacggtgcctaaagtgcattttgtgatggactatgcaggcggaaacggcatgaaagtgacgccggaggtgacgattctggacgctgcagagaaacaggcggacgcagacgtgacggtggaactgtggatgacgggggaagcaccggacgtgacggtcaccgtggcgggagagacacagacggttcccgtggaaaacggttatgcaaaagccgtgtttgcgcttaaaaatgtgcatctctgggacggtgtggaggatccgtatctgtatacggtaaaagcagaacttccgggcggtgatgtcgtggagcggacgtttggctgccgcagctttaagatagatcccaaagagggctttttcttaaacggacgatcttatccgctacgcggcgtgagccgtcatcaggatcgtgcgggcgcgggcaatgcgctgacatacgagatgcaccgggaggatatggcgattgtaagagagcttggtgccaacacgatccgcctggcacattatcagcacgcgcaggagttctacgatctctgcgatgagaacggaatcattgtgtgggcggaaattccgtatatcacgatgcacatgacagacggcaccgaaaatacgttaagccagatgaaggagctgatcgtgcagaactatcatcatccgtcgattgtctgctggggactttccaatgagatcacggcagcaagcgcggtgaacgaagaactgctggagaatcaccgtagattaaatgatctgtgtcatgaactggataagacgcgtccgacggttatggcggatgtctttatgttagagacggacagcccgatgctggagataccggatatgaacagctacaatctctactttggctggtacatcggggaactggaacagaacgacagcttttttgacgaatatcacagcacttaccccgaccgggtgatcggactctccgaatacggcgcggacgcgaatccggcgtaccacagtgcgaatccggagcggggcgattacacggaggaatatcagtgcgtttaccacgagcatatggcaaaaatgattgaggagcgcccgtatctgtgggcaacgcatgtatggaatctgtttgatttcgctgcggacgggcgcgacgagggtggcaagcacggcgagaaccagaaagggcttgtgacgatggatcgcaggatcaaaaaggatgcgttctatgtatacaaggcatactggagcaaagccccatttgtgcatctctgcggcagcaggtacacggaccgtgcagaggatgtgacggagatcaaagtgtactccaaccagaagaaggtctcgctctttgtggacggagcagagaaagagacgaaagaaggtgcacgcatcttcagattccgggtgccgattacgggaacgcacacgatccgggtagtgtccggggactgcaccgatgagattacagtgagaaaagtggacacaccgaatccggattacattttcaacaagcagggcgacgtggtcaactggtttgacaaagaggattttaaagccgatcactattcgatttccgatacactgggggaactggcgaaaaatgagatggcaaacgccattgtgcagagcctgatggcacaggcttccgcaagccgcggcgatgtggcggagagcgtgaaggacaacccggcattgcagcggatgatgcagcgcatgacactggcaagtctcttaaagcaggcgggagacgctgtgagcgaggagcagatgaaagcgttaaacgacgcattgcagaaaattccaaagaactagggaacacgaagtaaggagcgcagaggaatgaaaaaagcagtacagcagatcatgcttggaacagtaacgaaaaatgaaaagcagacggcagagacgctgcggcggatcagggcggcaggctacgacggaatcgaactgaacggttttatggtgaagccgacctcttttctggtgcggatgctcacgaaggcggcaggaatgccggtcggaaaaggcggaagctatgattggaatgcactcgtaaaagaagcgggactttgtgtgacgagcatccatgaagatcttggaacgatcagacgggagccggagacggttgcaaaagaggcagaagccttcggcacaaaatatgtcgtcatcacgggaatgtaccgctttgattactcggataaagccgcggtgcaggggctgtgccgggatctgaatacctccggaaaaattttgaaagaggcgggcattgaacttttataccacaaccataactgtgagttcctgcacgttgagccgcagaaaacggcgtatgatctgctcctttcggagacagatccggaatatgtcaactttgagctggactcctactggccgacggaggcgggcgtggatgcgctcgccctgatgaaaaaactggacacgagaatgaagctttatcatatcaatgaccgcggcactcgtcttttgaagcctgccatgacgccgatcttaaaatcggacagcatggagcttggctgcggcaatatgaatctggatgcactcattgcacaggcaaagaacgtgaatgtggatgccgtgattttagaaagccataaaaactgggtggataactctccgctgcggtcgctggaggtaagcgcacagtttttaaacgcacggatctgacagagcgggagatggcagaataaggatggaaatgcagatggaagaattaagaaaacagtggatcacttcagaaaaagaataccgggagggcgaggtttttgtataccggcagaaatttacggcttcacaggtcaaaaaagctgtgttttacggcacagccctcggcgtgtacgaagcagaattaaacggcacgaagatcgggagccagatgtttgcaccgggattttcctactatccgagacgtgtgctctatcagacacacgaggttacggagctgttgcgggaaggagaaaatacgctgacggtctatctcggacaggggtggtactgcgggcgttttctctgcgaaaatcagacacagatatacggagagcagccggcggttgcatggattctggaactggaggatgcggcaggaagccgaaggattgtctccgacgagacggtggaggaactggaatccccgtatgaatatgccggagagtacgatggtgagatttattttgcagacggaagagagaacgtgaccggtcatgcgtccgcctacacaaaggaggcgccgttcgcactggagccgacgcttacggaagtgcgtctgcaggatgagatgccggtgcgggaggcaacggtgcatggagatgtgacgatccttgatttcgggcaaaactttgccggaattgtagaaatagatccttcttttttgaaaaatgagacaattacgatccggcacggggagatcttaaatgccgacggcagcctgtacaccgcaaatctgcgcaaagcgaaggcgacgattgtctaccatgcaggtgcggagaagaaaaaataccgcccgcgctttacttatatgggatttcgttatatggaactttccggtgcggcatatcagccggggatgatcagggcatacgcacttcacacagagatgaagcgtaccggatatttttcctgtgaaaatccgctggtgcagaaactctatgagaaccaggtctggggacagaaatccaactatgtggaagtgccgaccgactgcccgcaacgggatgagcgcatgggttataccggggacgggcaggtatttgcgctgacaggggcttataatttcaatacggatgcgttctggaaaaattttcttcgcgatctggagctggggcagcttgacaacaccgagggatatgtgtgcgccacggtgccgcagacgggacctgccgggatcggatttatcagtatgctgggatggggcaatgcggtcacgattctgccggagatgatgtaccgtcagttcggggacgaggaggcactgccgcgccagtatgagagcatgaagcttttcgtggaggcggagatccgcaagatggggaagaaaaatctctggatcggtccgtcattaggcgactggcttgcgatgggaaaaggaatcgcatggcaggcgatgcacaacaatccggtgtcaaacgcgttcatcgtgcatgatttaaaggtcatcagcgagacggcagaacggcttggaaagcgagaagatgcggcgcggtaccgcagacagcttgccgcgacgacggacgcttatatcaaaaaatttgtgagcaaaaacggaatcgtggcgaaggattatcagtccgcttacatcatggcattaaaatatgtgctgccggagggcgagctgcgggaacgggtcaagaaaaactttgttgccaacatccgtaaaaacgggctgcagacgggattttttgcgacggagcatttactgccgcttctggtggaggcgggagagcagaaacttgcctatgatgtattactgcaggagaactgtccggggtggatgtaccaggtgaaatgtggcgcgacgacaacctgggagcgctgggatgccctaaagccggacggaaccgtcaacgaggagaaaatggcgggctccggtgaaaatatggtatcctttaaccattacgcattcggcagtgtcggggagttttactatcaatatatccttggaatcagaccggaaaagccgggctttgcaaaactgcattttgcaccttatccggacgagcgcctgggaggcgtatccggaagctatctttccgtggcagggaagatcgagagcgcatggcggtacgaagcggacggctgtcatatccggcttgcaacgccggtggaggcggtcgtgctccttccggatggaagaagtgagaatgtgcctgccggaacgtacgagtggacggtgaaaagaccgaatctgtaaaaagtgcaggatatgtaaaaaaaatccggaatctgcctgaaaaagggcaagaaaggaaattgacggcggcaagacatagatgataaaatctcatgagatatacatgtaaaggatgaaaattatgtttgcgaaaatcaatttccacgatgaattctaccagaaattaaagcttctggtgctgccgatcacgatgcagcagtttatgctggcgctagtcagcgccacagatgccattatgcttggggcggtcagccagacctccctgtcagcggtgtctctggcagggcagatccagtttgtcttaaatctgtttatcagcggtatctccgccggctccggaatcatggcagcgcagtattgggggaaaaaggacgcggcttccattgaggaggtcatgccgattgcactgcgcaccaatctcatattcagcggtgcgttcaccgtgtttgcggcggtggcacccgaggtgctcatgcgcatttttacgtccgatcctgcgttaattgagagcggagcggtctatctgcgcgcggtgtccctgtcatatctgctgtgcggtatttcacagatttacctgattttgctgaaaaataccggctatgccacggtcagttcacggatcagctgtacagcggtcgttgtgaatattatctgcaatgcgatcttgatctacgggctgttggggcttcctgcgttaggaatacagggagcggcttacgcgacggttgccgcccgtctggtggagctcgtttggagttatctggagacgaagcagtccgggcgtgtgcagatcatctggaagaaaatgttccatgcggcggatgccgttctgacaaaagatttctggcgttataccatgccggtgctcggcgctgcactcgtctggggaatcgcctacgtgtcctactctgtgattatgggacacatgggaagcgacgcggtggcggcaaactccatcaccacgatcgccaagaatatgctatcgtgcctgatccgcggcgtcagcggcggcgcgggcgtgctgatcggaaacctgctgggcgccggagagctggacaaggcaaaagtgtacggcggcaggctgacgcgcatggcaatcgtggtcggcatgaccacaggcggtcttctgatgctgatctcgcctttgatcgtgcgttttgcaccgctcagtgagacggcggcggagtatctgcagtacatgctgatcttttgtggctgcaatatcatggcgcagtcggtcaacacgacagtgctggacggcatcttctgtgccggtggggattccaagttcgacatgaaggggaatctcggggcgatgtggtgcttttccgtaccgtttggcttctttgcggcattcgtgctgaaatggccggtcatggtggtgtactgtatcgtgaacctcgacgagattgtgaagattcctgctgtgtacttacattataaaaaatatatctgggtgcggaatattacggtacaggaagacgcttgacaaggtgcttttagccctccgggcaggatgcacacttgcgcgaaggagagacatgccgcaggcgaccgcacttggtgcgaaaatgtgtcgtggcatattttttattgcagaaaacgtttgtgagaaagcctggagaaggctggcgcgggtctacagaggaaaaatagctgcgtgagaccccaaaaccgcttgataagagagaaaaagagggataaatccatggcttttgggcactggaagcaaaaaatacgccgtgagacccggaaattgtaaaattccgggtctcacggcgtattttatcggctgtagacccgagaacgctccagcagatagaaaaaatgatcaaaatattccagaaaacgggtctcacggcgtattttatcggctgtagacccgaagtttcagaatacagagcagccggaataaatacaaccatggtacagaaagttgcatgaatccgccgggagattatgaaatgcagaaagacattatttatagtgtatgactgtatgcagatttgacgagcaccgtgaatctccgggcggtttgcgtggaaagaattccttgcaaaagcgcgggtgctgtaataccataaatacatgatgggttgtagaaggagtagcttgtatgggtgaagatataacggtcagagagatcgggatttatttattaaaccgagtcgaagtgacgctgaaagatgacagcagggcggaaggcattctgcagaacatcacggcggagacgatcactgtagagggcagggagatcatgctttcggatgtggcggatatccggctggcaggggaactgacagattatgatgtgatgcgtgataccggaatgatcgggaattttacatttgcgccggaagcctgccgtgatgctgcggaactggaactcatgcggtatggagattttgcgtgtaccgtgtcctgccatctgaagcttgcatccggaaagatctgcgcggatgacatccggctggtatcgcacatacacaagatctgcgcggaaaaattaagccggacggcagcaatttacagcctttttgatggaacatttttagtcggcagattgcagcaggatggaaccgggatgctggagcagtcaggcggcggacaggttccggtcgattttgccggggtgaaggagattttcccgcttccggagaccaacgattcactgcatgtcaccatgaaggacgggagctgtcgggagggtgtcgtgtcggctgtgacggacaccatgttcgtattgatcggtgagggcgtgtccatgattccgtttgccgatatgcaggaaatccgctactgcgggaaagtggtgcgtgtgcgggaaccgggcagccgggggaagacggatacgtggaagatcgcagtcggaagccgggatgcagaagatggtttctggtgcagagtgccggaacattccggagcagcgcagatcgacgttggagatcaggtctcctttgtgccgggaattacggattgcgaatggatcgccaaggatgtccggctggtgaatgcggcaggaaaggaagaaccggcggaagcggggtatacaggaaggggaattattttatttttcccgaatgcactccggacgaacggctttatcgggaactgctatgtctcacagaattatgcgaagatggagaacgccggattgccgcgcggaaatgtcatgttttcacaggagcagattgactttggattcaaaccgggcaatatctacgtggtttcctacacctgcgccaaagaaccgggtgaggtggtgcaggaggcggtcagtgtgacgctggagaagatgtatccttatgcggattatgcgaaagtgtggattgacaggaacggcgaggtaaagatgctgccggtctctgttttttatgcgaagaagtttgtgggacaggacgtggaagtgctgctctcgaatggagagagaactgccggaaagctgaaggaatacacggatgaaaaactgacgcttcttgcgggagacgatggcgcagaagagacggttctgcagacggaagatatcgcgcaggtgcggtatgtgggactcattacggcttaccgcacggataacggtaccggttatatttccggggaatactggttccatgtcaataatctcacagatgccggtgaggcatcgcagctggttctggggcgcagggtttcatttacgcttgagcagactttaaagggcaagctttgcgcggcgaaggatgtcgctctgatctcagagaagactgtcattgcagaggagaagcaggaagaatccaaaccggagagactgcgcggttatatcgtaaaatacatgatcaagcagccggtcagtgcagggttcggttttattgtaccggaggaagaactggaagcccatctggaggacaaggagggaaccgtctatttcaagcagaccgacattgactgtgagacgatgccgaagctgaataccaaaagttattattacgaggttttatataccccgtataccctgcatggcaagacatgcgcgaaggatgtgaagatcggtgccggacatccgtatccggagaaaaagtcaaccgctccggtggcggtgaccgcagtgacaaaaaagattgtttcaaagacactgccgcttgtggaatatctggaaacggaggaggcgcgctatgtgggggcttctccgaaactcggaattatctctctctacaacggacactatgcgctgatcagcgactgctatatcaataaaaagcttgtgacagatcaggagtatgcaccggacggcgcgattgcgatcttcaatccggagcttgcacagatcgaaacggaagagacgataaagacagcaaagcactgttatctggtaaaatatgtgccgggcggcacaatggtaaatgaaaaaaccggcatggagcatccgtccgttgattataattatccggttctggtgttggcgtcctttgcgaagaaccagtatatctgtcttaaaattgaggcggatgcattgcaggtgcggaaagtggagcaggtaatgtccacgcttggcaccgccgtaccggaacaggtggattttgatattccggagctttgcagcggggagagtgtgatcttcgagatgacggattccacggcggcttaccacgtgatcgacagcgtgggggatgatttttaccgtgtaaaggacggaaaacagatcctgaaaaatgagattcagaagatctaccgtttcggtgttgtcacagactttaatatggaggaaggcattgcggtgatcaaccgtgtcatgaatttttccctgacgctggcagacccgaacgtcatcaatattttaaagagccagatgaacgtgacacgcctgcatgttattttcgcctgcgaggacaaccggatcacggaagtgcaccgcatatcggaagcttacagcggattgatccgctggcaggagggaacggtcacgcagtgcgatgaactgcaccgggcaatcgtggtggaccagaaggcaaaacactatatgtctgtgctctcggacggtatgatcaaccgggcatttaagagccatacgctcaccgggcagagagtatttgtaaaatgtgtgcaccatgtgtttgcggaggagggacagacggtgctgtctctggcagaatctgtgatagagatccggtgtcagagagagacggcaaccatccaatacgatgcggggcgtgatatttatctgggttaccgtaacgcgacgaaatattatccggtttacggtgcctcacagatactggcgggatatgtgaataaggaaacggcgattgtttttgcaccgggtgcggacggactggaactggaggcgcgacttgtggaggcaggaggagcacaggcacagccggaagctcagacggaggaattcgaggcggatgaagcttcggtcacgctggaaaatgcgatcggcgagaatctggcaaagttctgtatggaacaggtggatttaagccagctgctgttaaagggagtgaccttaaacgagcagagcatgccggaaaatagtgagaatgcacagagagcagtggatattcttcacggacagccgggggaactgcaatcctttgcggctgccaaaatcgcgcttgcctatccggaggtggagctggagcatggcgcggaagcgggtggaaaatatgacagagagaaccagatcggaagactgttgatcggcacattgcagaagaactgccgcaagatcggtctggacgccaatatggtattcggggagcagacgtattacctgtccgttctgctgcgttatccgctcagaaagagcaataagaaaaatgcagcgcaattctcgatgggcgactgtctctatcagctgtttttgcaggacttcggcacgagagagcagcttgccaactacttacagcaagggaagaccgcagaccgcggacaacttgagacgctgctgaaccagaattgcaggcagatgagtgaacttatctcccacatgatgctgctggatcagaagagtatggagaccgtctgcgccattttaaagaagaatacgacgctgaccaatgagctgcttcgatatgcggtgcagattgacgatatgatccgtacgaccagccttgcggaagcgctgcaggccttgcgggagcgctataagaaggacagaagccgcttttcggcaaacctgaccggaatcctctctggaagtaatatctctgcggatgtgagagaactgattttaaacatgcaggtgcgttttttaaagctggcgggaaaggatgacagagcgcgctttgaaaagctgcagagggcgtgcatgagcgtctgcgattacaccaatcagccgggattttcattacaggagcgcctgctgcgggatgcctaccgggagatccgcgaactggaggaagagatcaagaagcatccgagcagagaggcggtagagattctgtggatgtgtacggacggagcggatggcgccaacatttttgcaaaattgaaaaaagagatcgcacagctgctgaactccatgtatcaggatgagaagacccgcccgaagatctggtgcaagccgaaccaggaactgatcgagaacggacagaagacgttctggctgatcgtcgggaacggagcagcaaatatgaacctccagtcggcggacaacgtcgggattattttggaatcctacacagagggcgtggacgttccttctaaaatcgtgttggaacagaagcacctggctgccggggatcagatcccggtcgaggttgcgatcagcgtggaggaaggatatacaggaagcttaaatatcggctggtccgtggaatacgaatacacgaccgcatttctgaccggggaaaatgaccgcaacggcagtctgcagaaaaagacggttcgcgaggatgccggcaattatctggaactgcagtacggcaccggcaggatggaaggtaaggataccggtgcagagaatccgtatctggaaccgtcgcagggacaaccgctggaagacaataagatgttcttcgggcgcgaggaggagagccgcgagataagaagcagtatccttagaaccgtagacggagaggaacagttcattccgggaagtgcagtcattatccacggacagaaaaagagcggcaagaccagtctggtctatcagataaaaaattatatcaaggacaatgagaaactgcgccaaaaagcgatcatgctgaattttaataacattctggacgaaaccggcggcgtggaactgcttccttactttaagcggtcgttttatgccaatattctgtcccgctttgaaaatgagatctacgatcatcatccggatgtggtggagcttttaagacagaatcagcttgaaattccggatttgtttgatccggcaggcaatgagacgtgggcggcgctcttcgagagatttttccgggagtttttccggtatgatggcggggaacatgtgattctcctgtttatggatgaatttacgcttctatgtacgaccatcatgagcgagatacgcagagacaaagagaaaaatgagagcctggcggctatcccgaactttatcaagacattttcacagtatggttttattcaggtgatcatcggacatgaggcgatgatgcgggcatttgacagccttggcgtactcaaccacacggcggaatttgccaagtctgtggagattgcggcgctggatgaggaggcgtccgtccggctggtgaaggagccgatggaacgggcattcgggtatgacgtatacgacacggaacttggaagacgggcggtggagaagctattggatctgtcgggatgtaatccgacgtatctgatgcggctgtgcagccagatgtttgcttactttgtgagtgaccgctgtccgagatcacggattctcgtcagcgatgtggaagagatggtacggcagtttatcagagagctgctgctgacggattttgatatccttctggtggaagacggcgacagcgtggaagatccggaaagccgcaagacgtatcagtatctgaagagtgcggcgtttgccacggtgaaatcctttgatcagagaacgtccgacatgaaggagatcaaccggaaactcacagaagaacagggatatagcacggaggagatcgagcggaccaagaatctgcttgaggcacgccgtgtgatctccattacatccggcggaagagtgaagatcaataccggattgtttgtggaatttatgttacagaagaacggaggaagagaataatgggtgaattatatattgaacgaaaggaggtcagccagatactgaggaaaaaggtcttcttcgtggaggaaggagattatggcaagtgttattcgctgattggaccaaacggcatcggcaagacgacactgatccggcacctgagcgacgaactggagagggcggcaaagccgcacacctactattttaatacggtgctggaggcaggaacctcgttctggcagttttggacagtactgattctaaaattttctgataccatcggggaagaggagcttcgcgatgcacctgtgccaaatgacaggctggtggagaaaatcctcaaatcctatcagttctttgaagaaaatatcgggcatcaggatgacgtcgtctttaagatgaatgctacgagagaattgtcttcgttgtttgaatattatacaaagcttggaatccggatgattctgacaatcgatgaatttgaccgggcacaggcaatcttcaaggacgggcagtttttccagcgcttgtttggtctgacgccaaagggcgccaaccggctgaatctgtcgatcattacgatctccaggcggagcgtgagcacgatcgcgcatcatatgcaggaggggtcgaattttcaggatgcgtttccggcactggcactgaaaggtttttccaatgaggaattggaagagtattttaacttctacagggatatgccgtgcggtcttctggaggagaaggaaagacagcagatcctttgtctgtgcggacggtcgccggggctgctgatgcagatgcgggatgaaatcgagaatctggacgggagtcctgttgacatcggatggattttccgggagcggggagctttcatcaagacggcgtatgagcgtatgtgtacactcatgagaacagagtatgtgaatcagagcaagaccagaagcagcatgggcatcttcattgaaaagtttatcggccctgcatattccgaaaagcttaacgagtgggtggaaaagctgtatgactatggatttgtgacccgtgtggagaagtctgaaaaaaatgtgtttgaactggcgggtctcacggattaccgcgataagggagaactggtatatgagccgatctctccgtattttgttgattttgtgaaggattttgctgttttggatgaactggattcgctcgcagcaatgttagagcagacggagcggagcatccgcgacgtattgatgcgggcactcagtaaggaatactcggaagaatgggagacggtactcggtcaggatgtgcagcgaaaggatgattatctggaaaatctgcgccggattgcgaccgagaacgaggcggatcagagaaatattatcatctccaagctgaatgtgctcgcgtttaatgattactttcagattatccgcaaacactgggatattatgaaaaagtatttcagcctgtattcgtctcttgatgagttaaagcaggatatgtacagcttaaacaactgccgcaatacatccgcgcatctgaatctggagatattaaacgagtcgggacgccatgatttgcgcaagatttgtgaatttatactggaaaatttcaaatgtgcaggaggacagcggacggcagaggcattcggcactgcggcagaggcatccgctgagaagccgtcacagccggcgggcggtacgggagcctggcatgagtccatgatcggtcagacagtaacgctgacacagacggaggcaacgacgaccggtgtgctgcgcggcgtgatcgcgggcacttcacatggagcatcgctgtcgaaaaaatatcttcttggcagggggacaccggcgcgcatgctcgctggcaaagatcagaggatccgtcttacccgctgggatgaaaatgcacagaagttcaatgcggagctggtataaggagtgtggaaaaatgaactataagcggattacagaccttccaggtgtgcggattgcacgcgaggcgatggtggtcggagacgtgacgatcggggaggacagctgtgtgctgttttactccaccgtgcgtggggatgagggaaccatcacgatcggaagagagacaaacattcaggaaagctgtacgattcatgcgagcatcgagggcgatgtggtgattggtgacaatgtgaccatcgggcatcaggcggttgtccacggatgcacggtcggcgaccggacgctgatcgggatggcggcgacgatcctggatggagcggagattggctgtgactgtatcgtcggggcgggaagccttgtcacaaagcacacccgggtgccggatggatcgctggtgctcggaagcccggcgagggtcgtgcggcagctgacggaagcggagaaaaaagatatttaccgcaacagccgggaatatgtgaaggtggcgcgtgagatgcaggagcagggactgctcccgtaacaggcgcaataagcatatcgtgctttgctttgataagtaatattatcagaaagaagaccacatcgtgggatttcagaatttgtttctcagctttcggtattctctcggcgaatatcctttcaacttgtgaaaaagccgactgaaataaagctggttatcatatccgacaatcttagaaatctcattgatggaataagttgttgtttcaagtaacatctgagcattgttgatgcggattcccacaatgaattgcattggtgtagaaccggtatattttttgaaatttcggataaaccagctgacactcatgcctcgtgaggcagcataatcatcaatattgatattttgattgtagttttcactgaaaaaggtaacagcattatccatctcataatcaagatattcattttttaatatgtgctctcttgtcagttcccggtggaaactgatcagaagatgacgtagcaaaaggacaagcatttcctcataattgtcttgacagcgttggagctcgataatgatacgtttgaaaatttgttcatattcattagatgtacccacttgaaagacacgttctttatccggaaacccatattgacgtaagatatttttcacattgcttcctgtgaagtgaatccagtatacttctgtcttatcttctccgtaatattcatatttttggagttctttcggtctgtacagtacaatgttgccggctggaacaatcgtttcattatttacattatcaaaatgaaaatgcccacaaccagcagtgatatatataatctgataatccagacgaccccttggacggtaggtcggaagtttgggatgtctggaaagacggtaagtaccacagctaccgacaatcagcggacgacttttgtctttgaaatccatatgtgagtggttcaaataaccggtgttcaaatacataggacagcacctcttttcgtactttttatcattgtatcatttagtgcatattttgtctaatccaattcatagacatattttgcggattaggataagctatatatagcataactaaggaacgtaaacaaaaagtaaagtataaggtttgctttaggaaaacaaagaacaaaaaagtatatgtattggaggagagctatttatgatcgtaccacgttattatgaaaatctaagcgtactgcacgaaaacacaatgccagccagagcctattatattccggcatccagaagaatggataacttggtggaacacagagaagagtcagatcgtatgcagttattgaatggaacttggaaattccagtattttaacagcatctatgacattcaggattctttctttgagaagaattatgatacagaaaattttgatgagattcaggttccaagtgtatggcagatggctggatatgatacacaccagtatacaaacatccggtatccatttccgtttgatccaccatatgtgccacaggacattccgtgtggagcctatgtacatacttttgagtacagtagagatgagaaagcgccaaaatcttttttgaactttgaaggagtagacagttgcttttacgtatggatcaatggctcttacataggatacagccaggtttcgcatatgaccagtgagtttgatgttaccgatgtacttcaggatggaacgaatacggtggcagtgttggtaatgaagtggtgtgatggttcctatttggaagatcaggacaaattccgtatgagtggtattttccgggatgtgtacattttgaaacgcccaaaacaggcaatcagtgattatcatattaaaacaagaattgaggatatgcttgcgaaagtagaaattgaaatgaaattctactctccgttaaatgtaaaaatttcgattgaagatagaaacggagcagttgtagcactaggaagtattgctgaagaaggaacagctgtattagaaatcgcaagtccggaactttggaatacagaaaatccatatctgtataaactgattcttgaaacagaaaatgaagtaattgtggatcacattgcattaagaaagatagagattaaagaccaggtcatttatctaaatggacagaagattaaattccgtggagtcaatcgacatgattccgatccggttacgggatttacaatcagtctggaacagattacaaccgatcttacgttaatgaagcagcataattttaatgcgatccgttccagccactatccgaacgcaccatttttctatgaaatgtgtgacaagtatggattcatggtgatagatgaagcagatattgaagctcatggtccatttatgatttacagaaaagaagacaccgattacaatcggttcaagcgatggaatgagaagattgcagatgatccggtatgggaagaggcaatcgttgatcgcgtaaaactcatggtggaacgtgacaaaaaccgtttctgtattgtcatgtggtcaatgggaaatgagagtgcttatggctgcaactttgaaaaagcactggaatggacaaagaattatgatccagaccgcatcacacaatatgagagtgcaagataccgtaattatgatgaaacatatgattacagcaatctggatgtgtacagccggatgtacccagcgctttccgaaattcaggaatatctggataaagatggaagcaaacccttccttttggtagagtactgtcacagcatgggaaacggacctggagattttgaagattacttccagatgattcaggataatgataaaatgtgcggcggctttgtctgggaatggtgtgaccatgcgattgcccatggaactgctgagaatggaaagacaatctatgcttatgggggcgaccatggcgaagaaattcatgatggcaacttctgtatggatggattagtatatccggacagaacggtacatacaggacttttggaatacaagaatgtttatcgcccggcaagagttatttcctataacaaagaaagcggagaactggtgcttcataactacatggattttgatgacttgaaagattatgtgaagatcagttatgaactgacacaggatggtcttgtgatcagcaaaggcatacttccggagttttctgtggcaccacacggggaaggaaaaacaaacctgaagatcaatgttccagagaatgggaaatgttatttaaaacttatttatcatctgaaaaaagaattgccactgttggatgaagaccatattcttggatttgatgaaattgaggtaagtaaagaggatacaaaatgtaaacttgcagagaaatggaaaccaaaaacagtagtggactctgaattacaggtaaatgaaaatgatacacagattcatatcaaggggcgtgaatttgcttataccatagacaaacgtactgcactctttacagagatgaaattcgcagggcgggaatacttgaaccatccgatggaattaaatatttggagagctccaacagataacgatatgtacatcaagtctgaatggaagaaagcccactatgataaggcttacacaagagcctatacgacagaggttgtgcagggaaaacatggtgtgaagattacaagccatgcttccgttgtggcagagacagtacagaagattcttgatgtgacgattacatggaaaatagaagctgctggaaagattgatgtagatattgcagtaacaaaagacgatgaattcccggatcttccgagatttggtgtgaggatgttcctggataaaaaactttcagctgtaagatactttggaatgggaccacaggaaagttattgtgataaacatcaggctgcgagccacggtttgtaccgggcagatgtaggggatttacatgaggactatatccgtccacaggaaaatggaagccattatgattgtgaatatgtagagcttaacaacagccgatatggaattgtggcatccgcagaaaaggcattttcattcaatgcttcttattatacacaggaagaacttgagaagaaaacgcataattatgaattaatagaatcagatagtgtagtattctgtgttgactacgcattaaatggcattggttctaatagttgtggtccagttgtattggagcagtaccgatttgatgatgtattattccggtttcagtttacactgataccgtatgtaaaggggtaataaagtttcatgtaacccgtaaacaaggaaagagagtctgattgtaatgtaaagtccggatatacagagcaatcagacaaaaacgaaacaaaagaaaaatttagaattaggcatcttgagattctaagtgcaatgaatatgaggagcaaaagaattctatggaagaaaaaaagtatttgaaatggtataacaaaattggatacggatcaggtgatattgcaggtaatgtagtctatgcgttcctgacatcttttatgatggtctatctgacggactcggtaggacttgctgcaggtgtcgtgggtaccctgattgccgtataaaaactatttgatggttttacggatatattttttggatcaatgattgacaaaacacacagtaaaatgggaaaagcgaaaccctggatgctatacggatatattggttgtgccattacgctggtctgctgctttgcagtaccggtgagtttgggaacaacggctaaatatgcatggttctttatttcttatacactgttaaatggtgtgttttatacagcaaacaatattgcttattcagcacttacgtcactgattacaaagaacagcaaagagcgtgtacagatgggatcttaccgttttatttttgcattttcaacaagtcttctgattcaggcgattacagttggatttgtagataaatgtggtggagatgctgcggcatggagaacggttgctattatctatgcaatcattggtctggtcgtaaatacgatttcagcactttctgttaaggaacttccggaggaagaacttaatgaaggagaagtaaagaatgataatgaaaagtatggaatggtacaggcattcaagcttcttgtcaaaaacaaatattacatgatgatttgtggaacatatattttacagcagttatatggtgccatgattggagctggtatttattacatgacatgggtactgaaaaataagaatttgtttggacaatttgcatgggcagtaaatattccactgatcattgccctgattttcacaccgacattagttggtaagtggaaaggtatgtataaactgaacttaagaggctacgtcttagcagtcatcggtagagcacttgttgttgttgccggatatatgggcagtgttccgctgatgatggcatttacagctcttgcagccttaggtcagggaccatggcagggagatatgaatgcagttatcgcatcttgctctgaatacacttatcttacgcagggaaagagaattgacggaacgatgtactcttgtacttctcttggtgtaaaaattggtggaggtattggaaccgctgttgttggatggatgcttgagtttagtggatatgtcggaacaaatgcaactcagccacagtctgcacttgatatgatgcagttcatgtatctttggcttccgttaatctttgatgtattgattatgtttgtactttcaaaaatgaatgtagaagatgcaaataaaaaactgaaagcagaaaaaggaattgctgcagatgaagtaacagatgcattagacataaattagaattgacaggagaaagcgttgtctggtcgttgctcgatgggacagtgcttttttctatatataaagtgatagaactgtattttgaaaataaaaaaggaccacttcatttttgtgaaatggccttaagaaaatattcagttttcacaaaatagtccttttagtatttatacatggtaaggatgctcaaaatattcagtgtagaatactaaaaggtcattcagatatttttttaggttgctcatttgcaattcctcctttccttatttacaagttgattataagataggtgtaaaaggattgcttgccaaatcgaaagaagatatagacaaatgttgcaaaggggagtatttcatgcagttaaaatatgttgacacaaaagaggagattatagcaataaataggaagtcaaaacatattgaaccacatcttcataatgcactggagatcgtttgtgtaacaagtggatcattagaacttggtgtcggacaggaactataccatatggaaaaaggagatataggctttgtatttccagatgttattcatcactatcaggtactgacacccggtgtaaataaagcgacttatctgattgcatcgccatttacgatagccaaatttgcagatatcatgcaatccatggctcctgaatacccaatcatcaaagcggaaaaggttgaaccggaggtatatagggttataaatgcaattttagagacagaacagtcggatattactgttgcacaggcatattttcaaattgtgttggcacgctgcataggaaaattaaacttggtagaaaagagcagtgtggggagcaacgatcttatttaccagacagtttcctatatatcagcaaatttcaagaagaagttttcgttggaagagatggcaaaagacctgggcgtgagcaaatatgttttatccagactcttttccaagacatttcatagaaactttaatcaatatcttaacgatgcaaggctgaactatgcatgccatcgtttggaaaatacgagtgattctattacaaatatttgtctggatagtggatttgaaagtcagagaacgtttaaccgagtatttaaagaaagatataaaatatcaccaagtgattatcgaagtacctgtgtgaaagagatgttgtcataaaaggttctgttgatcgaaatatttactttgattttacagtgctatgtatttgatttcatgtgtggatgatataatgaatcatatcggattcatattggaagttcctgcggaacttcagatgcgcagaaagcagcgcaaaaagatgatataatacattttttaagacgggaaatgcttgattttacagcatttccagacgaatattccacctgcatttccacatgaaatctccaagtgtgtttctaataatattacttatcactcaaaagcagtctatgcttattgcgacaattcttttgatccttgacaagatgcctgatgtcgtatatgatacagatagttagaggagactaactcaaaagatcgttgatacaggagggatcggcatgagtcgtgagacatgggagattttgcagcagatggagccaaaagatgtggaattgcagcttgcactgcagtgtgcgccgttaatcgcaggcttaaagccgtcgaatctgttcaatattccgtgtgagggagtatgtcaggttcgggagctgatccgggataccggaatatccatgtatgtgcttttttcaaccggcagaaaagcggctgtgctcttataccgaagagaaagcctggaagaatacatggaacaggaacaggtgaaaaggatgctgcataaactgggatatcaggatacttccttggaggcggtgcttcctgttttccggatgcgttaccgcaggtacatgcaggagcgcagggatttccctcatgagatgggactgcttttgggttatccggtggaggatgtgagagggtttatcgagcatcagggaagagattatctctgcaccgggtactggaaggtatatgagaacctggaacagaagcagcagctattccagcggtttgagtacgcgaaagaaaatctggtactgctgctttcctacggagtgggaatggcggatattatggatatcttcggcgggaccggacaaaagacgctgtaccaggaatgtgcaggttagaagtgatgggaggacactgaagaagattcagtgtccgtttttgtatcatggaaatttttttttgccgcacattttgcgccggaactggcgggaggcttgacaaataggaagtgattgataaaataaggttagtaaaagctaactgaaaaggaggcttgcaaatgaactggagtgtattttacggaatattgataccgtttcttggaacatcgttcggcgcggcgtgcgtgttttttatgaaaaaggagatgggagaccggctgcagcgtatgctgacgggatttgccgcaggcgtgatggtggcggcgtcgatctggagtcttttgattccggcgatggagcaggttgtcgatatgggaaagctggcgtttgtgccggcagtcgcagggttctggtgtgggatcctgtttcttcttctgctcgaccatatcatcccgcatctgcaccgtaacagccagagtgcggagggaccgaagagccagctgaagcgcacgacgatgctcgtgcttgccgtcacattacataatatcccggaaggcatggcggtcggcgttgtgtatgcggggtatctggcgggcagcacccagatttccgcggcggccgcgatggcgctgtcgcttggaatcgcgattcagaatttcccggagggggcgattatttccatgccgcttcgggcggagggaaccggaaagccgaaggcattcttaggaggcgtgctctcggggattgtggagccgatcggggcgattctcacgatcctggcggcgggactgattgtcccggcactgccgtatctgctcagttttgcggcgggggcaatgctctatgtggtcgtggaggaactgattccggagatgtcgcagggagagcactcggatgtcggcacgatattttttgcggtgggattcagcgtcatgatgatgctcgatgtggcgctgggctgacacttttattagaacgggcggatggctttgtgtctgctgggtatgaaaacgccagaaaagattccgaaaaatataccatagaaacaggagtgggaacagatgaaagtatatgaagttggagagcagggaaagccagttctcatgcttttgccgggaaccggctgttactggcgcagcaattttggaaaggtgatcgagccgctggcggagacattccgggtggcgtgcgtctcttacgacgggtttgacgagacggaacagacgcagtttcccacgatgatcgaggagacggcgaagatcgaggaatatattaaggaacactatgacgggaaaatctgtgcggcgtacggctgctcactcggcgggtcattcgttggacttatggcagcacgcggagtgattcatatggattatggcattctcggcggttcggatctggatcagtctgcaaaactgccggcgaagctgatgacagccctgatgctgccgatgatttatccgtttcttacgaccggcagatttcggcttccgtttttaaaccgtaagctggagaagtggcgcaaggcgggagacggatatgtggatgcgtttatcggcatgatgcgcggcgccggtgtggatctctcctttatcacaaaggagagcctgcgcaatcagttttattcggatctgattacgccgctgccggatgcgatcgatccggcgggcaccgagatccacattttatatgccttaaagatgggagaaaaataccgggcgcgctatcacaggcattttgcgcacccggtactgcatgaactggacatgcagcatgaggagcttcttgcagtacatccgaaggaatgggtggagctgatagaggatatatgcagacagaagtaatacggaggaagaacagcaatggaaaaaattgtggtaaaagtggatggcatgcagtgcggaatgtgcgaggcacatgtgaatgaggcagtgagggctgcgtttccggtgaagaaggtgacctcttcccatgcaaaaggggagacagtcattctgaccgaacaggacattgatgatgcaaagttaaaggaagtcatcgacaagaccggctatgagatgggaactgtgacgagggaaccttacgaaaagaagggacttttttccgcattccgtcatgaaaagtaagaaaaaggatgtctggatagagcgccctgtctggggtattccgtttagtgaataggtgcgaaggtgtgaaaccggagctttatttatgaggaatcccgggcagggcgtattttatgagttgctgtttgttatggtattcctgttctgacgcagagggcagccatgctgcacacggtaaaaaggagagagacgatggagacttaccggaatgaggagcagatgcagtgtctggcgaagagcgaaggatgcagtacgcttccggtcagcctgtatctggcggaccgcgtcagcattaccggggcgcaggcggcgcttgcggtgatgctttcgatgtcgctggtcggatcgctggcaaagcttgaagtatttttccaaaatatccgtcagatgaagatgacggcggagtagcggtgcagtaagggaaagggcgttcttatccggcggagaatccgcaatgagaaaaagtatcaacatccggggttgcaatctttttcgccaaccgttataatgacgacagttaggcgtgactaactatagtgcaaatcattttaggacttcttacaggggaggagctgctgaatccgtttcctgccggaaaacagctgcaccgggacgcgttccatcctatgtaacgaacgccttccggtgtgttttccggaagccggagtccggatggatcaaagaatcagatgattgaaaagatcagagaatcagatgatcagatggaaggagaacgaagcatgaattttttggagattgaaaaggtaatcggaagagagatactggattccagaggcaatcctaccgttgaggcggaggtcatacttgcggatggcaccgtgggaagaggcatggcaccgtcaggcgcttcgacgggagagtttgaggcactggagcttcgtgatggagataaagcgagataccttggaaagggtgtcacaaaggcagtggagaatattaacacggtcattaacgatacgatctgcggcatggacgcaagcgatatttacgcgctggatgcggcaatgattgctgcggatggaacgaaggacaagtcaaagcttggcgcaaatgccatccttgcggtatcaattgcagcggcaagagcggcggcgatcgcactggatatcccgctgtaccgtttccttggcggaatttccggcaacagacttccggttccgatgatgaatattttaaatggcggcgcgcatgcagccaatacggtggatgtgcaggagttcatgattatgccggtcggcgcggcaagctttaaggaggcgctccgctggtgtgcagaggtattccatgcactggcagccctgttaaagagcaaaggccttgcaacctccgtcggcgatgagggtggttttgcaccggatcttgccagcgatgaggaagcgatcaagtacattttacaggcagtgaaaaatgcgggctatgagccgggcaaagatttcatgattgccatggatgcggcgtcctccgagtggaaaggcacaaagaagggtgagtacatattgccgaaggcaggtacaaagtttacttccgaggagttgattgagcactggaagaagctggtggagaagtatccgattatttccatcgaggatgcgttggatgaggaggactgggaaggatggcagaagctgacgaaggagctgggcgataaggtgcagcttgtcggcgacgatctttttgtaacgaacaccgagcgtctcaagaagggaattgacagtggctgcggaaatgcaatcctgattaaattaaatcagatcggctctgtgtcagagacactggaggcaatcaagatggcacataaggcaggctatacggcaatttcctctcaccgctccggcgagacggaggacacgacgatcgcagatcttgcggtggcattaaacacctgccagatcaagactggcgcaccgagcagaaccgagcgtgtggcaaaatacaaccagcttctgcgcatcgaggaggagctgggcgatgctgcggtatatcccggcatggcggccttcaatgtgaagcgctgatcttagggagtgagcccggatcgggatagcggatcgtttcgggacttgccgtggcggcagtgcagactgcagatgagcaggaggagactgcttgagcagcttatcaggacttggcgtggcggcagtgtagacagccacagtgcagaaagaaaagaagtctgcagaaaaaataaaactttgaaaagggaaatgtacggacagccggcgcattctgcgccggctgttttttctgcctgccaggtgcaatttttttccagtttgatagatgacctgttttttgcttttttcgggtcaatggaagtatggaggagcttgtcagtctactgcgggtctacagaaggaaaaaagacttgcgggacccgaaaatgccattgcaagagggaaaaagaaacgaaaaatcagctcttgcgggtctgggaggaagaaaaagccgtgccagacccgaaaaagcagaaaaaacgggtctgggagattgattttcacgaatcagacccgaacagaaggaaaacaaatttacataacgcaaaaaaatatgctattgcgggtctgagagagaaaaaaagccgtgtcagacccgcacattgctatgcaggcagggaagaccccagaaatatttgaagaacaggtttgtgggaatagaaaaaagccgtcaaaaagtttgccggcaggataaataaattccgacggatcggacatactagcgcaataaggcaaaggcaagaacagcaggcaggaacaacaggcaggaatgaaaggttgaggcaaaaagcaggagcaaaaagctgaagccaaaagttggagtaaaagtcggagcaaaaagctgaagccagaagttggagtaaaagacaggagcaaaaagctgaagccagaagttggagcaaagagttagagcgagagatcgtgtgaaaaaatggaggattctatgaacaagtatgccagaacacagacggaaaagaatttgaaagcagcgtttgcaggggaatcacaggcgagaaacagctatactttttttgcggagatcgcaaaaaaggaaggctatgagcagattgccgcgatttttgagaagacggcggataacgagcgcgcacatgcgcagatgtggggcgaggaactgggactgatcggcgatacgggaaagaatctggatgccgcagcccacggggagaactatgagtggacagacatgtatgaggattttgcaaaaacggcggagcaggaaggctttgcggcgcttgcagcgcgatttcgcatggttggcgcgattgagaaaatgcatgaagagcggtaccgggagctcctgcgggatgtgcaggcacaggcggtgtttgagaaaagcagtgtgaaagtgtgggagtgccggaactgcgggcatattgtggtcggaaccagtgcgcctaaggtttgtcctgcctgtcattatccacaggggtattatgaggtgcgggaggatgtcaggggagcgtagaagtgtctggcgatttgtgagcgtttcgtatcagtaatatttcacaaaatttatagatcaaatacatgaaaaatatataattgacagaaactatgattacttcctattaggaacactgtaaatacaaggcttttcggagcctgcaaaccagaaaaaataatatttgatctatcacattacgcaaaaagccgtccggcatgagaaacgggcggcttttttgcgtggatagacggaaaggaggcgcaaaaataactacaaaattttagcgttcaaatttgtgcaactttaacgaaaaggaggatcgtaaatggccgatgaaaaactgaatactggccctgcggagaatatttccccggaggccgccgagcctatcgccacacccgaacaggccgtagcatctgaaccccagcaggaacagaccgggcctgccatacctgagcccggcgatgtggttgtgtcctttgacaaaatcaatgagcttatggcagaaaagagacagaacgcccgcgccgaagtcgaaaaggcggaaacccccgaagcgccggaggcggcagcccccggagaaacacagcagcccaccaatacggaggaaccgaaaaagccgcgccgtggccgtccgccgaaagcagaaaaggccgcgactgaaaatcaaaaatcggagaaatcggctggggcccgcaagggccgcccacccaaggcggataaggcggcccctgacaagcccaagccgtccaaacgagacaaagtgtcccgaagcgatggaaaggccccggatgccaaggagcccattaagcccgcacaggatacggcactgaaggaaactgctgctgtggaacagacggctcccgagccgactacaccgccccgcccggttgaggaaggcaagctggtttatctgaaactttccgaggttcatccgtttcacacattccgtccgcacccctttaaggtacgggacgatgcgaagatgcaggaaatcgttgcttctatccgcgtaaacggtgtaatggttcccggtcttgcccgcccggagaaagatggaaacggctatgaaattgtagcgggccatcgccgtacccacggcagtgagctggctggactggaggaaatgccctttatcgtccgtgaaatgaccgaccacgaagcggtacaggccatgaaggacagcaacaagcagcgtgacgggatgctccccagcgaattggccgcgctgctggaactcgaggttgaggacatcaagcatcagggcgggcggctgaaaggtgttgcggaaggcgatgtcgggaaacgctcggttgagattgtaggcgaggcgcatgaaatgaactataaaaaggtcatgcgctacttgcggctcaactcccttgtgccggagcttctggataaggtagacgataaaaagatgggcttcatgcctgccgtggagctttcctacatcaaaccgaaaaatcagaggcttattgctgtttccattgacggggagcaggcttcgccctcgctggcccaggccaaacggctccgggagctggataaggaaggcaagctcaacggcgatgtcattgacggtatcttatcagaacagaaaaaggaggatcgaggcgtgattatttctactgcggaactggaaaagtattttggcaaggaggtcactcccgccaaaatgaaagaacagattatgtccctgctggatgactggaaagaaaaacagccgccggagctggcaaaagccccgaaaaagcaggaacttgacaagtaacaacttcgagacactttgtcccgagggccccgccctcgcgcagaggctctggtggtatatatcccccgtcgccgcctgttttttagtacagccgggagtgggccgtcaagggtgcagcgcaccgccgttttcggcggctcgcccttgacggtctgccccggctgtgctatttccccggcaagcggcgggggtatatcctccagagccgccccctttcccaagactgggaaagggcgtggggtttgggttgaactttcttattaaaatatcggaggtatgaacgatgaaacgaccccttgcttatatcaccgctgcatggctcggcggcgatagcgaaaacgcagaactggcggcgcagtattgccgcaccgtgtatgaggcaggcttttctcctatttgtccgcctttgtacttgcccctgtttctcaatgatgctgttcccgaggagcataaaagcggcatcgacatgagccgtgacctgctccgccgttctcatgtgctggttgtttgcgggcacagtatgaccgaagccatgaaaaatgatattgccgtggcccagcggctgggaattacggcaacaacccttgagggcatcctgaccgtcaagggacagggccgccgctaatggcaaccctgtttgaagcctacgttaccaacgccggaaagtacagcgagggccagcttgtgggtgaaacactgaaatttcccacaaccgcccaggaggtggaggctcttttgaaacggatcggcgtggatggcgtccgctatcaggaaatttttattacctctttcgatggggatgtgctggggctctatgaccatttgagcgagtatgaaaatctggacgagcttaatcatctggcctgcctgctttccgagcttacctcatcggagctggaaacactggaggccgtcctcgacagcggcgatcactgttcttcggtgcgggacatcatcaatctgacacaaaatctggactgttacggcttttaccccggcgtatccgatgaggaaacgctggggcgcatttatgtggacgatctggaaatgttggatgtgccggatcaggtaaaaccgtatttcgattatgaggcgtatggccgggatgcctgcatccacgaaaacggccattttgccccgggcggctatgttgtcaaagaaagcgatcatttcgtggaagtgtatcacggcttgcaggatattcccaaggaacataaggtattctctttcccgaagctctctatccgggagcaaatggccgcctatcaggaaatcatagacggttcttcgctggagggctaccgtcaaatgcagaaaaaagaccgtggggatcggtgacggtacttcgagacaaattgtcccaaggaaggaggcggtgtaactgattgatgaagatatttcccggcgcacgatagccatatccgtaaaaacaaccaagctgacggcgcggggactggcgtatgtgctgggtatggtggggcggaagatccgcaaggcataccgtgggcggcaaacaccacacggcaagcaaagtgtgcgaaagctcatggcacacggtacatccacaaacagcatcgagctatccggggatgccaagtcctttgaccgtgtggcccggaaatggaatgtagactatgcgttctataaaaccgggccggacaaatacctgttgtttttcaaggctggacaggcagacgcaatgaccgcctgcttttctgagtattcccggaaggtgttaagcaaagcaaaatcgaaccgagttcccatccgagaacaactgcaacaggcggcggatcagctttccaaagaaaagccgaaacagaaagaacatgcaaaggaggtggcccatgaggacagataagattagaaaatatctcattctgaacattccctatctgttcatcctgtgggcgttcctcaagctgggaacggcctaccggctggcggcgggtaacgattttgcacataagctcatcgggctgggccagacgattggcccggcctttgctgactttgcacccggtcttgctccgctggattggcttgtcggtattgtaggcgcagttggtttccggctgctgatctatttcaaaagcaagaacgctaagaagtttcggcgggatgcagaatatggcagcgcccggtggggaacggaaaaagacatcaaaccgtttgttgatccaaggtttgaaaacaacgtgattttgaccgggacagagtttctcacgatgaacacccgcccgaaaatccccgcaaatgccagaaacttgaattgctgcattatcggctcgtccggctccggcaaaacccgcttctggctcacgccccagcttttacaggctcattcctcttatgtggtggtcgatccgaaaggcggtgtgctgggacaggtcgggggtttcctgcaaaaacgcgggtacaaaatcaaggtattcaacagcatagatttttcaaaatccatgcactataacccgctggcgtatatccgcaacgaggccgatattctgaaattcgtggatgccctgatttccaacaccaagggcgaaggcaaggaaggcgatccattctggacgaaatcggaaacgcttttgtactgtgctctgatcgcctacatcattttcgaggggcctgccgaggatcggaacatgaatacccttgtggatatgatttccggcatggaggtcaaggaggatgacgaggattttatgaacgcggtggactatatgtttgccgggctcgaaaagcgtaagccggattgcttcgcggtcaaacagtataaaaagtacaaattggccagcggtgatatatgctctaagtgacttcttaatcatgattttgtcatggttagtgaagcaatcacttagagcatttttgtttcaggaggtacagccatgagaaatgaaaaaattaccccactgtacgagcgcctgagccgggacgacgagttacagggcgagagcaattccatatccaaccaaaaacagatgttagaggattttgcccgccggaatgggctgccaaaccctacgcactttacagatgatggtatctcaggcacccgttttgaccgccccggatttttggcgatgatggaggaagtggaggcagggcgtgtagaggcaatcgtcatcaaggacatgagccggttggggcgcgactatctgaaggtcggtcaggtcatggaggttttgcggcaacgcggtgttcgtctgatcgccatcaacgacggtgtggacagtctgaaaggcgatgacgattttaccccattccgcaacatcatgaatgaattttacgcccgtgataccagcaggaaaatccgttctgtgtttaaggcaaaaggtatgagcggcaagcacctgaccggcactgtgatttacggctacttatgggacgaaaaacgggagcattggctggtagatgaggaagccgccgaagtggtacgccgtatcttctccctcacgctggagggatatgggccttatcagattgcctgcaaattatccgcagatcggattgaaattcccgtcgtacaccttgcccgcttcaacgagggtgtgaaccgttcaaagccggtcaaagacccctatggatggggatcatctaccatcgtgaacattttgaaaaaacgagagtatttggggcacaccatcaatttcaagacccgcaagcactttaaggacaagaaaagccactatgtttctgaggacgaatggacgatctttgagaatacccatgaagccattatcgaccagcagacctttgatttggcgcagaaaatccgcagcaatgtacggcgttatccaaacggctggggcgaagcggctcccctcacaggattgctctattgtgccgattgcggcggcaagatgtatgtccaccgcaccaacaatggcaagaggatttctcaatatacctgttccaattataccaaagttccgtgtgggacactatgccatacacaacaccgtatcaatgagagtgctgttctgacattggtttccgacacgctccgggctatcgctgaatattccaaaaatgaccggacggaatttattcacaccgttcaggaaacgcaggttgcccaacagagtgccgatatagcgaaaaagcgcaggcgtctggccgctgctcaaaagagagccggagaactggaaaaactgatttgcaaaatctatgaggacaatgtcctcggcaagctgccggatgcacgatatagggcgcttgatgcacagtatgccaaagagcaggacgcacttgagattgaaattgcggagctggaaaaggctgttaccggctacgagcaaagccagaaatcagcggagaaatttatagccctgattgataaatacgagaattttgacacgctgacaaacaccatgctcaatgagtttgtagagaaaatccttgtccacgaacgcgcccgaaaaggcagtcaggacaccacgcaggaaattgaaatctacttcaattttttaggacgctatatcccaccatccttacagccggttcctttaaccccggaggaacaggaagaactgcggaaaaaagaagaacgcaaggacaggcttcatcagaattatttgaagcggaaagccagcggcgcacagaaacggtatgaggacaaaatcaaggcgaagaaaaaagcggaaatggacgctaagaaagccctgatccgggctgaggatatgaaaaaaggcgttttttctactgtcggacagctgccgaaagaagaaccacgcaaaggcagcatagcagccagcgcagcagtctaatcatcacgaagcaaaggagaatgaatatgagtaagttgacttacattcgttgtggagattatgatatacccaacctaaaactttctgaacagccggaaacttctatcggcaagtacggcagaatgcgaaaatcctacctaaaggaacatcgccccattctctacaaccatctgctgatgagcgagaagctgtatccacacctgttagagattgagcggacagcacaggggcgtgtggaaaccatgttgcctcacatgatggaagttgcgggtgtcacggaagaactgaaagcctgtcaccctatgcgttgggtggggctgatgaacacattaacggcacagattgaggaaattttaatcagggaactgatttgcagctgaatgggaggtgcgggaaatgctgacctttgaaaaggttttgaaagtgtttcaggcatatctggatgatgaccctttgtatgaggtggttcagaccagccacggttatacattgatggcatgggagctccaccggaatgactggtacagcgccgagatacagaaaaccccggaggatttacggaacgctttgttgagtacatacgctaactttctggaagataagattaccggaaatgaccgcgagctgactgtgacagaaaccggagaaatccagcagaggtgtcgggaacttttggaaaagtgccgggaaccttgatatagaaatgccagaaggaggccgcgattatgcgtcctccttctgcttcgcagtctgttccattttgagcgccccgtctatggcaccttcgataatcggcaggtattgttcaggacagagcttcagcttgtggctgacccgctgccgctgtgcgctttcttcccgcatgatctccgggttaaaatatcgctctacgggaagtccgcagaccttaatcaactggatcatcacaggcaggctcggaatcgcaccttgattctcaatgttggcaagataccgccattcaatcccaaccatttctgccaatgtttttcgtgccaaacgctttgcctctcgtgcggctttgacatctgcaccgaaggtttcaaaaccgggacaatcttcaactttcgccatataacatcacccagttacattgtataattcatactttgtccgtggaatgttgctatatgcaggttggttgaagtttataattcacatttcgttccttgcattgttcgagaaagagaactataatgtactctgtggaggtgcgaaatggactatatgacattgaaagaggccgccgaaaagtggggcgtgacacctcgtagggtaaattattattgcgccggagggcgcatccccggcgctgtgaagatggctggtgtttggctgatcccaaagaacacagaaaagccgattgacggaaggacaaaacaagggaaggagttgcgccatgaataaaatcctgattatagatgatgacagagaactgtgtgctttgattaaacgcagcgtacaagcagaaaacatagaagctgatttttgtaatactggaaaagagggtttacagaaattaaaagagcaggaataccagcttgtagtgctggatgtgatgatgcccggtatggatggctttgaaacgctggaagaaatccgcaaagagaacagcctgccgattttgatgttcacatccaaaaatgacagcatttctaaagtgcggggcttacgagccggggcggacgattatctgacaaaaccgtttgatatggacgaactgattgcccgtattgcgtccctcattcgccgctacacccgttttaatcatcaagccggagctgtgcaaaaactggattttgatggattgcaaattgaccttgaaaatcgttctgttacgacggaaaatggcacttttgaacttccaccaaaggaatttgatttgctcctgtactgtgcaaagcatcaagggaaaattttgacaaaacagcagatttatgaggaagtttggggcgaagaatatttctatgatgacagtaacattatggcgattatcagccgacttcgtaaaaaattagaagtcaatccttcaagcccaaagtatatacaaacggtcaaagggattggctaccggtttaataaggaggtgtagtcagcatggaaattatcgtattcttgtccattgtgattgctgttgtggctgtattgacttccatcgttctcattcggcgcgtaaaaaagcaaatcgcagaaatgaccgatgcactggttgatgtgaaagacggaaatggcaaccggcgtattctatctgcaacaaatgaactgacagcacctcttgcctatgaaatcaacgagatcgttgtggcctatgaaagcagactttcaactgtacggcagacagaagaaaccaaccgccagcttatgacgagcctttcccacgatgtgcgaacgccccttactactctgattgggtatcttgacgctgcacacaaaggactggtcacaggaaaagaccgggatgattatattgaaaccgcccgccggaaagcccatgatctgaaagaatatattgatgtactctttgactggttcaagttaaattcaaacgagtttgctttggagatccagagcgttgaggccgcagagctgacaagaaatatcctcattgactggataccgatttttgaggataaacaggttgagtatgacatcgatattcccgaacagcctgtccgggtaagattggatatggacagctatatgaggatcgtcaacaatctcattcaaaatgtaattgctcacagccatgcagacaaaatcaaaattgccctgtcaaagaaggaaaataacatggagctgctgctggcggataatggagtgggaattgagaaggaagatttgaaacacatttttgaacggctctataagtgtgacaaaggacgctctgaaaaaggcagcggacttggtctttctattgtccatcagcttgtagaaaagatgggtgggagtataacagttgaaagtttgccgggaaaaggaactgaatttatgttgctttttcctttggagatttaagcgggttcccgtctttatggcgggaacctttgtcatttttgccggatttcaaattgcaaggttaatgcaaggttgcggcaaggttaatgcaaggttggcgtgatagaataccttacagaacaggaggttttgaatatggatacaaattacatcattgaaacaaaaaatctgacgaagcaatatggctcgcaaaagagtgtggctgacttaaatatccatgtgaagcgtgggagaatttatggtctgcttggcagaaacggagccggaaaaaccactaccatgaaaatgctgttgggcttaacgaagccgacttccggagaggtcaaaatctggggaaagtctttacaggggaatgaaaagaaattgctgccccgtatcggcagcttgattgagtcccccggtttttatcccaatctgaccggcacagaaaacctgcgtatttttgctactctgcggggtgtaccaaacaatcatgccatcaaagatgctctggatttggtaggacttccctacaaagataaaaaactcttttctcagtattctcttggtatgaagcagcggcttgccatcgcccttgccgttatgcacgatccagaacttttgattttggatgaaccgatcaacggtctcgatcctatcggtattgcagaagtacgctcttttattcgggagctttgcgacgcaagaggaaaaaccattttgatttccagtcacattctttcggagatttccctgctggctgacgatattggaattatcgatcacggcgcattgctggaagaagaaagccttgctgaactggagcaaaaaagcagtaagcatatccggtttacactctctgatactgcacaggcggcaagaattttggaacgcaatttccatgaaaaccatttttccatacaggacgaccacaatctgcgcctgcacaaccttgatctgcctgtggggaaaattgtaactgcctttgtagaaaacggattggaggtatcggaggcgcatacttgtgaagaaagtcttgaagattacttcaagcgtgtgacagggggcgaaggaattgcttaaactaatcaaatgcgaatttttgaaattaaaacggaagcccttggtatttatttctctgctgctttctgttttcatgccattggcttatgctttctttctggcagatgtaaacactgatgtggatgctgtaaatggagtgatgtccagcctgttccagctcagtgcttatttgcttttgatgccgctccttgtgatactggcttccaatctgctgtttgaggagctggacaatgacacactaaaaaaccttgttaccataccgataaacagaaccaagttggtgctgtccaagatgctggttttgctattgtttgccgttggctttatggcagttggaggattggtaaatcttgcggttttgctgtttcagggctgggagccggttgggttttggatcttgtttggcgttgggatagaagaagggctgattatgtgggtaggcgcacttccatgtatcctgctcgttgttcttcttaataaaaactatatcgtgtcggtcgtgattacctttttctatacgactgcaaattatatcctttcgatgagcgatgcgttcctcacacagccttttggtttgaatatcggaaccctgtttccgggaccgctggctttccgctggaccttccaattttatgaccaaagccagaccagtgcggaattggcagacttgttggaacggatcagtccgtattttctgaatggtgttcaggtgttcggtgtgattgttgtggaagccgttgtatttcttgcgctgattgcgttggtttaccggcgccaggaaatctaagggggtgtaattatgtgggatttattaaaagcagaattgctcaagctacgccggtgccaaatactttgggtggggctggtggcgcttgcactctgtccgttggtgcaatatgggagccagctgattgtggaggcggagtaccgaaatccaaactatgatttttccactctgtttgagaatgttgtctggggcaatacgcagatgttttttccgatttcactggtgatgattggcagctggctgattgacagagaatccacccatgatacgctgaaaaacatcatgacaattcctgtttccatgccgaaaatgctgggagctaagctcttttgggtcgggatttttgcagtcctgctgggaatatacagcgttggcgttaccttgattactggattgacggttggattatcgggactgacagtggaagtgttttttcatggaggtacacagatcgtgttggcagctctgacgacctatttggtctgtatgccgctgatcttgatttttgggcagatccgaggggcatatctgggaggttccattctggcgtttttccttggatatagcatgctgttcttcaaaggcggtatccttgccagcatctatccgttttctgctgcgctgattttagtgggctttgacatgagtggatatgccggaacaaccacagccccgaatcctttgctggcagtcattggggttggcatcatggttctctgggcggtgctgttgttactgatgtccagtaacaaaaaagaaataaaatcccgtaaacaggcaaattccaagggaaaaggaaagcgtgctgtacgcaggaaaggaaggtgatacctgtgaagaaaatagttctatcattatgcttgatactgttgggcgcttctgtgctttccggttgtacaaaagatgaagttctcgatcagtataacaatattgttcagtctgctggttccatagcacttaccggaaattcatccttacaaggtacgaaagaaaaaggaattgatgattatacaggaagctatacagccaactatgaggatttttcagatacagagtatttgttcggcggaacttccataaagcgtgaagcgggtaaggatctgtctattgactgcgcgctggaggttacggatggaactgcaaaagtattttggatttctgaagctgatgaagaagtcactttgcttgaaacaaccggaacatatagtgatacaattacactccctgaaggtggaaactatatcggcattgaatgtgaaaatttcactggaagcattgaattgaatatggagtaacattctgccggacgacggcaaaagaaaaaaagccgtcgtaaagcagacacatttccacgcgcctatgaagcggcggctttgatttgcagagccgccgtttcttttcgtttatcctaaaccaacgacgacctaacaccgtgtaaatccacggcggcacataggaggattgccgccgtgtctatttttgccttttttcacagtgcccgtgatctgcaccagctaaaaaaagcctgttcccagcagcggagcaatgcggtcagcagtatgcactataccatgtaactgaacaacaaaatatactctattacgctcgtatggctttatgccgtccgggcgcttttttgtccttatggagccggaacatcgggtcagcatggcccgaactttatccccggtgccgctccccgccgcctcattcagatttacccaaaaaatctgaatggaggaaaggcagatggaagttaccatcaattataacggacaagttgtggccgtggaggtcacgctggaagtctatgaatttcttgaccgggccgatcacaaaacggagaacctgtttcatgaacagcggcggcattgggatggccgggagtttgacgagtacatcattaccaccgagggtgtaggagcctacggtgaaacgccggaagaatacctttgccgcatggaaacgctgcatgagctgatggcggttctggacacctgtaccgaggctcagcgccgccggttcctgctctatgcgcttgacgggctgagccttgcagagatcggtgtgctgtgcggctgctccaaagtggctgtgtatcaaagtgtggaggcggtcagaaaaaaatttataaatttctttgagaacaggcttaacgaatgacctgttttctggctaccaagtgaaagggatcatttcccttatctcagcgaggggcggacagcggacgagctgcccgcctctccgattttcaggaggtaagcctatgaaaacaatcaatctgcggtggatgtatccccactaccggcatgacgagtttgtggatgttacggacgaggtatgggcagcgatgtatcaggcccagcgggagatggagaactatgagcgtcggaaagtctaccaccgcgcctactactctctggacgcatacagctggctggaaaattacgcactggaacacagcagatcgccggaagatattttgctggaacgagaagaaatgaccacccgcctgcacctgatagcagctctgctggtggctctgactcatgccactccgacacaggcccgccgtgttcacgcctactacattgccggtatcaagcagccggaaatctcccggagagagggcgtccacagcagcaaggtcagcgtttccatccgtcggggtctgcggaatatgcgccgctgctatgatgacctttttcaaacagagtgagggcgtgcctatgcagaccatcaatctcaaacaatattatccattttgcaaagaggacatttttgtggaggtgtccgatgagatcgtcgaagcgtttcttctggataagagagccgaggccgccagagagcgcaagatgttccggtataaggcgttttattccctcgattgtaacgacggaatcgaaaatgccgcaatcggctgggcacagccatcgccggaggatcatctgatagaaaaagaagaattagccgaatacgaagaactgatacggcgattgtatgaagccatttcttccctgccgcctatgcaggcccgccgtgtccacgcccgctatatgctgggtatgaaagtgaaagatattgccgcaatggagggtatcacgccatcacaggcgggaaaatccatccatgccgcactgcggaggctgcgccggtactttgtgcgtcagaaatggacggtcaatctatgagtatttccaaagaaaagaggtgcatgacatgaacgaacagaatacagcccaaacaaaaagtgaggaacaagaggaagttctgaaggagattcggcagcttgaaaaccgaaagaagattttggagaacaagcagcgaaacgaagaacgcagggttcgcacccgccgcctgattgagcgcggagccattttggaggggatttttccgctggctcccaacctttccggcgcagaggtcaaagcatttttgattgccctgtcccatcttccgggggctgcggaattgactgcaaacctgtcaaaatccggggatacgccataagtcccttgtttacaagggcgcacttatacaccgttgccggtgctgtgcgccctgccgggggcgttgcgtacttcgtccgcgatgggaagctacgctccccaaaccccttgtgcgctctgcgcagccaaacacccactttgcgtttgtccggctccacagagcctgttatccctcactgaaaggaggtgttccccatagatttctgtcatatccccgtcagtatcatcaagcgcagcgcaggccgttctgccgttgccgcagctgcttaccgcagcggaaccaagttgacaaatgaatgggacggaatgacccacgactacacccggaaaggcggcattgtccatgcggagatcatgcttcctgcccacgccccgccggaatttgcagaccgttctatcctctggaacagcgtggagcaaatcgagaaagcaagggacagccagcttgcccgtgagatcgaggcagctctgccccgtgaactgtccggtgaacagcagcttgcccttgtgcgcacctatgtgaaggacaactttgtagacaaaggaatgtgtgctgactttgctatccatgacaagggaaccggtaaccctcatgtccatatcatgctgacgctccggcctctgaaagaaaatggacagtggggcgcaaagtgccgcaaggcatacgatctggacgagaatggacagcgtatcccggatgggaaaggcggctggaaaaatcacagagaggatacgaccaactggaacgataaaggaaatgtggagatttggcgggcagcgtgggcggcctacaccaatcgggcgctggaatctgccggcagaccggagcgcattgaccaccgcagctacaagcggcagggcattgataagattccctctgtccatctggggccagccgccagccaaatggaaaagcgcggcatccgcaccgacaagggagaagtaaaccggcagattgccgctgacaacaagctgctgaaagaaatcaaagcccgcattacccgtctttatcgctggtcgaaagatgaagcggaaaaaccacaaacacagcaaagcagcttgaccgccttgtgggaggcccagcagcagctgaacacttcccgcacccgcaccggcaaaatccgggccttgcaggaaagcgctgcactattcagctttttgcaggcaaacggcatccaatctatgcagcagctccatgaaaaaatcgctgatatgaacatccgttactatgacctgcggggaaagatcgtcaaggcagaacgccggatcgccgctcttaccgagcgcggggagatgtgggaacagtacaatcagtacaagtccatccacaaacagcttgccaaagtaaagccggaaaagcgggaacagtttgagcagcgccacagcagggaactgatcctgtatgacgcagcagcccggtatctgaaagaattgaaagacagcggtgaggcaattaccccgaaggcatggcagcgggaaatcgaccagctgaccgccggaaagcagacggacacgctttccatgaaatccatgcgggaggatttgaaagcagtggaacggctccgcaaaaccgccgatcagctgtcccgacaggaaagggataagtctcacgaccgtgggccggagcggtaaaggctaccgcgttttggcgtacccctgtcaagtgcgtcgcgtttcacgacatacttttgcatacagaaaaaccgtcgtacaggtttccccatacggcggcagactgtttatttgccgaacaagtcgctgtgtgtgccggtgcgggccagcgtcagcaccagaacatcatcctctatgcgatagacaagcagccagtccgggagaatatgacattcccgatgacctgcccaatcgccggacaggtcatggtcacggttcttatccggcagcggttcgcccattgccagcaatgctacgacctgctccagcagctcaatcttcaagccacgcttgatggctcgtttgtagtcctttttgaaactggtcgtgtacttgacggtatatttggtttctttcatcttttcaggtcagcaaataactcgtcaaggtcattgtagccctttacagacgggtcttttgcaatcctttccgcttccagcatggcagcaaccgtttctttgttcggctgttccagccttacttcaaagggaatgccgccttcacgaagcgactggcgcacaaagatgttaaacgccgtagtcaggttcatgccaagttccgtaaacagtgcgtccgcctgcgctttcaaatctgcgtccatgcggatactgatgtttgtggtatttccagccatacgatcaacccctttctgctggcaattatagtatatgccatttgcacgaagaaaacaatactttgcacgaatatttaacaataaattcattcaaggaggttacctgctttatgaaagaaatcatttatgaagaacaacaagactgaacctatccctgtcatggattaccgccagtaccgcagagcgcggaaactggtgcatgagtgctgcaactacattgccggaaactgtatcgccctggacgatggggaggaatgtatctgtgtccagtccatttcctactccctgttgtgcaggtggtttcgggcggcggtattgccgcaggataaggaactggaaacggcgctgttccaccggctgaatgctaagaaatgcgccgtatgcggggcgctgtttacccccggttctaaccgggctaaatactgcccggaatgtgccgcacgcatgaagcggattaacgccgcaaagcgcaagcggaaacaacgggagaaatgtcacgctttaggggctgaaaaacccttgtaaatcaaggctttttttgagggtgtcaaaggcagtctgatagatttatcctctgacccctaaaatagccttaaaatgcgtacagaatcccaaaagaacccctaaggaggaaccctatgtcagacaatcgaaaatattattacctgaaactcaaagaaaactattttgatgatgattccatcgtgctgctggaaagtatgcaggacggtgtgctgtattccaacattctgctcaagctgtacctgaaatcgctgaaacatggcgggcggctccagcttgacgaggacatcccttacacagcgcagatgatcgctaccattacccgccagcagatcggcactgtggagagagccttgcagatctttttgaagctgggtcttgtggaagtgctggacagcggcacattctacatgagcaacatcgaacttttaataggccagtcctctaccgaggccgagcgaaagcgggctgcaaggcttcaaaataaggctctttctgcgctccggacaagtggcggacatttgtccgacattcgtccaccagagatagagatagagttagagaaagagatagagataaagagagagatagagaaggtacgccctgaaacggggcacccttcccacacctatggccgttaccagaatgttttcctgacggatgaagaactggcagacttgcaggtcagctttcctgctgtatgggaacagtacatcgaaaagctgtccgagtacatggcttctactggcaagcgttatcagagccatgcagcgaccatccggcgttgggccggtgaggacgctaaaaaaacggtcacaccctcacgcaaccgggattacagcgtaaaggaggatgaaactgtatgattgagattaccgcagaaatccgggcattcatcgacaaggcagctgccggtgtggaattggctgaggacgagtatatagacccgtcagacgggctcattcactgtaagaaatgcggcggccagaggcagaccgttgtgccatgcttcgggaaatccggctactttatgccgcactgcatctgccagtgccagcgggaggctgaggagcagcgcaaggctgctgaagaacggcagcgccgcatggagcgtatcaaacgccgaaaggcacagggcctgcaagaccgttatctgtacgactacacattttccaatgataacaggcaaaacccattgatggacaaggctcatgcctatgtggagaactggaaagaggcatataagagcaatatcgggcttttactgtttggagatgtgggaaccggcaagtcttttttcgccggatgtattgccaacgctctacttgaccaggatgtgccggtgctgatgacgaacttccccaccattctgaaccgcctgacagggatgttctctgaggacaggtcagagtttattgccagctttgacgaatatgacctgcttatcattgacgatctgggtgtagagcgcagtaccgaatatgctatggagcagatgtttttcgtcatcgacagccgctatcgcagccgaagacccatgattatcacaacaaacttgaaactgtccgagctgaaaaatccgcctgatctggcccacgcccgtatctatgaccgtattttggaacggtgtgcgccgatcctctttgacgggaagaatttccgggaagaaaatgccggtgtcacccgacaggcagcaaaagacattgtaaacagtaagcacgattgattttttaccgggcggcacagacccgttcggagaaaggagcgctatgaacaaagaaccccgtactatgcagatggcagacgccgctgctgcggccagagcgccggaaaacacgccagcgatggtaaagaaaatcggcaagacgacctacaaggttcatgtccatttcagcaataccagcacagaaaccatgagcgataaaatcaagcgtatgctcaaaaatgaaattcagcagatgtgacagactgataaactaagccgccttgtgctaaactgatgatggtacgcaccaaaatttttgtcaaggaggacatgaaaatgctttacacagaaaaagagaaacatgaaattgagcgagtaaaggaagtctttgcggaacatctgcggcaaagccctgattttgaattgctctggtcggacaaggtgggctatgtctggctgacgattggcgtaaatccagtctatgtggataccggtatcaggatagaatctgccgccgatctctgcggcaagtgtttggatgatgttgctacggatgttttatatatgactggcaacgatcatgcactggaagcagccgacccgctggagttagccgaaatcaagcggctctgggagccatatatcaaccagctgccagactatgcgtatctctgcaaagacctgctgaacggaaaaatgtaatctgttaaatgaggtgtcaggagccatacagtgcttctggcaccttttgtgagttttctgtgaatttgattaaaaagtccttgacaatttgtctctggcaagacggcaaaaagcattttgatttcctgcggtgcgcgactggctccctttgacatcccgcagcttcgtgaggtcatggcctatgacgaattggagcttgaccgcatcggagatcggaaaacggcggtattcttcattatttccgataccacgcagacctacaactttttagtggcacttgcattttcgcagatgttcaacctcctgtgtgaacgggcggacaatgttcacggtggccgcctgccgcaccatgtacgggtgctgtgggacgaggcagccaacacgggacaggtgccccagctcgaaaagctggtcgcggttatccgctcccgcgaggtgagtctttgcctgctgtatcaacagttggcacagtgcaaggccatttacgataagcacgccgagacaatcctcggcaacatggacagcgtggtgttcctcggtggccgcgaagccagcactatcaaggaaatctccgagaactggctgggaaaagccacaatcagtatgcagaccgacagccgctcccgtggccagtcggaaagctacagccaaaacacccagcggctgggccgggaactgatgaccccagccgagcttgcaaccatgccgggagacaaatgtattttgcagcttcggggcctgcccccgttcttctctcccaagtatgatctgaaacggcatccgaactaccgttatacggcggaggccgataaacagaaaaacgcttttgacctcgacaggctcattaaccgccgcaggcggcccgggctgaacgaggcgtgtacgatgtatgaggtggctgtgccggacgatgcactcacggaagaggacgaggacatcctcaactatgatgacatcgacgatccagacgcctttgcataaacgcttcgagacaaagtgtcccgaagtttgtaacctgccgcctgcatgggcggcttttttgttaccggaaaaatcccggagaaatggaggcttatatggcatttttctcatctgcaatcgacactttacagaccctcgttatcgctctcggcgctggccttggcgtatggggtgtggtcaatctgctggagggctacggctcggataacccgggctccaatgctcatgtgcggtaaagtaataaaaagatttaggtagccgccttaactattcctaaataagataatatgcacagtattttctcgtaaatagaaaataaattattgcattttaccaattattatgttaaaatgacaatgtaacaaagagctatgtatttttatagaaagcattgagaatatttcaaaatttcttgaaagtactctcagtgctttctttgataatatgaaaggagaaataaatgcaaaaaaaacaactttctgtattagtactaattattttatgctttttattaggatgtaacagagaaacaccaaaagatgaatctcaacaaaattatgaagatgaatctaatatttctaaaacaaatggagaagaacttgtaaatataaacagtgaattgttaggttcgactccttttgatatccaaatcgataaaacagcattgcagactagaaaagaaacagaaacagaagttacaataaagacaaatttaacagactggggttatactgtttcttctgaaaaagggaaaatatctgatataaataaaaattcattcatatatatagcacctaaagatgagagggatgatactataaaaatacaattatcggactatgaaaatggcatatcatatgaatatacaattccacttatttttgcgggaaacaatgaacattctttagataaattcaaggaaaatctttcaagattacctaatagttagtaaagagtcgatagactaaagtaccaccatcctcttttatttcaactgaatatccatcccgccgcaccgcagcggcacatgaagcagtaaatccgaaaaagatttgctgctttttttgcgtccatttttggcaaatttccaaaagttccgtattagacagtgaaaccaaaaaaggctgccatttttttcagacagcgggcaaaacgcagcttccgaaacgccttattgtcgggaaagaccgagccgccggaaaagttcttgccggaaagtccgtccattctgctcttttgtggtttgtagggagtaagggaaaaacgccagcccgcagccttttataaaaaaagctggttatagattttctgaaaaagtggcagtagcaagtgaacggcaggccggcagtttcttagagcaagattctaccgaggtgccaaaattcgcttatcgctcattttgcccctgcgggaatcttgttggggagtgccttccccaaaccctgcttatgcggcttgcgccgctgaaaaacccctcaaaatatttttcggatttttcaaaaacagttccgcttcacaccctgtttttctcctattagtgagaggacaccacgcacagaaaggaggtcaaccacctatgaaacgatacaacacgccgcaccgcagccgggtagtcaaaacacgcatgaccgaggaagaatacgccgagtttgcccagcggctttctgcttaccacatgagccaagccgagtttatccggcaagccataaccggggcagccatacgccccatcataaccgtttcccccatcaatgacgagctgcttgccgctgtcgggaagctgaccgccgaatacgggaggatcggcggcaacttaaaccagatagcccggacgctgaacgagtggcacagtccctatccgcagcttgccggggaaatacgggcggcggtttccgaccttgccgccctaaagtttgaagtcttgcagaaagtgggtgacgctgttggcaacattcaaacatatcagctctaaaaatgcggactatggcgcagcggaagcctacctcacatttgagcatgacgagtttaccatgaagcccacccttgatgaaaacgggcggctgataccgagggaggattaccgcatttcttccctcaactgcgggggcgaggatttcgctgttgcctgtatgcgagccaatctccgctatgagaaaaaccaaaaacgggaagatgtgaaaagccaccactatatcatcagctttgacccacgggacgggacagacaacggcttgaccgtagaccgggcgcaggagctgggcgagcagttctgcaaggagcatttccccggacaccaagccctaatctgcacccacccggacgggcataaccacagcgggaatatccatgtgcatatcgtcatcaactccctgcggatttacgaagtcccgcttctgccctacatggacagaccagccgacacgctggagggctgcaagcaccgctgcaccaacgccgctatggaatatttcaagagcgaagtcatggaaatgtgccaccgggaggggctttaccaaatcgacctcttgaacggcagcaaggaacggataaccgaacgggaatactgggcggcaaagaaagggcagcttgcccttgacaaagagaacgccgccagagaagccgccggacagccgaccaagcccaccaagtttgaaacggacaaggcgaagctgcgccggacgatacggcaggcactttcccaagctggcagctttgacgagttttcttcccttttgctgcgggagggtgtgaccgtcaaggagagccgggggcggctttcctacctcacgccggacaggacaaagcctatcacagcccgaaagctgggggacgattttgacaaggctgctgtccttgccctgctcacgcagaacgcccacagagctgccgaacagaccaaagccatacccgaataccctgccgcagttaaaaagccgttacaaggggaaaaagctgcaaaaaccaccccggcagacaacaccttgcagcgcatggttgaccgggaagccaagcgagccgagggcaagggcgtgggctatgaccgctgggcggcaaagcacaacctaaagcaaatggcagctaccgttaccgcctatcagcagtacggcttttcctccccggaggaactggacgaagcctgttctgccgcctatgccgccatgcaggaaagccttgcgtggttgaagcaggtggaaaagacgctgaacgggaaaaaggagctgcaacggcaggtgcttgcctattccaagacccgccctgtccgggacgggctgaaacagcagaaaaacgccaaagcaaaagcagcctaccgtcagaagcatgaaagtgactttatcatagcagacgcagccgcccgctatttcagggagaacggcatttccaagctgccgagctataaatccctgcaagcagagattgaaagccttatcaaagagaaaaacagcggctacaacgattaccgggcaaaacgggaggagtaccgccgcttgcagactgtcaagggcaatatcgaccagattttacgccggagcgagccgcagcgcagaaaggagcagagccatgaacggtaatatcccccgcatggactaccgccagtaccgggcagcccgccgccttgtgcatgagtgctgcaactatgacagcgggaactgcctgctgttggaggacggcgagccttgcgtgtgtgtacagagtatcagctattcgctgctctgccgctggtttaccgccgctgtcctgccccttgatgaagcactggaagccgccctcttgcgccggggaagccggaaacgctgcgctgtctgcggggcgttcttcttcccaaaatccaaccgggggaaatactgcccggactgcgccggacgcatgaagcggataaacgccgccaaacggaagcggaaacaaagggagaaatgtcacgctttagggcatttcaaacccgcataaatcaaggcttttttggagggtgtcaaagggtgcgtgatacatttatccttttcccttaaaaacgccccctaaaagcgtaacagaacccacagacagacaccacaaggaggtgaaccctatcgctgattatatgaccgcaggaacggagctgcccgcttacctgccttacccccgtttcctgctggaaacagacctatcccacaccgcaagagagttatatgcgctgctgttagaccgttccaccctttcgcagaagaacggctggcaggacagcgagggacggacatacattgtctaccccatagcagagatagcggaaatgctggataaaggctgcaccaccataaagggcgcactgaacgaactggacgctgccgggctgctggaacgcagacggacgggcttttctgccgccaaccgtctgtatgtgaaagtgccgcctatcccagtggtacagttttccgaccaactgacggacggaaaaccgcccctcataagggcgggaaaccgaccaactgacagccggaaaactgaccttatgacggtcggaaaaccgtcccctaaccaaactaatataaacaacctaatagagagccaaacaaaaggagcgagtgaggggcagccccccgccgcttatggcagatataaaaatgtatttctttctgacacagaacttttggagctggaacaggacttccccggcaagtgggagtattaccttgaccgcctttcctgccacatcgcttccaccgggaagcagtaccagagccatgcagccaccatttacaagtgggcgcaggaggacgctgccaaagagaagccaaagaaaggcataccggactattcattcaaggagggagaaagcctatgaccgatacaatccacaacaccatactgcctatgaccgacaccacagccgagccggaggattacaccggggaggacgggcttttatactgcggcaaatgccggaaacccaaagaagcctatttcccagagggcaagacctttttcgggcgtgaccgccacccgtcagagtgcgactgccagcgggcagcccgtaaggaacgggaagccgccgagaagcggcgcagccaccttgaaacggtggaacggctgaaacggcagggctttacagacaagaccatgcaggactggacatttgccaacgataacggcagctgcccgcagatgaagaacgccgccggatatgtggcacgctgggaacagataaaggacgggaactacgggctgctcttgtggggcagggtaggcactgggaaaagctattttgccgggtgtattgcaaacgccctcatggagcaggaagtcccggtgtgcatgacaaactttgcagcaatattaaacgaccttgccgccagctttgcgggcaggaacgaatatatttcccgcctttgcagcttccccctgctcatcattgacgattttggaatggagcgtggcacagaatacggtctggaacaggtctacaatgtgattgacagccgctaccggagcaggaagccgctgattgtgacgaccaacctcacgctggaggaattgcagcacccggaggacaccgcccacgcccggatttatgaccgcctgcttgaaatgtgttcccctctctgctttaccggggagaatttgaggaaagccgccgcacagggaaaaatggaacagctgaaacggctgcttgccggaaaggagatttgcctatgaccgacacccagagaaacaaacgccctgcccgccgcccggactgcgtgaccgaaacgaggataggcaacacaatccttgtggtgtctggctttttcaaggagggggcgaccgacaccgccgctgacaagatgatgaaagtgctggaagcagaagccgccgccggatatttgacctgtgataagcctgattgaaaaaccgtcatttttaccgaccgtaaagaagcagatttgacgcttttgccgctatacagacagccgccccatgtggtacaatcaaggtacggaatagtggggctggctgtcggaaacggaggaatttatgttaagacagaccacccagcaactcattaccgccctttacccaagactgtcccatgaggacgagctgcaaggcgagagcaattccatttccaaccaaaagaggattttggaaacctatgccaaacagaatggattttctaatctgcgctggtacaccgacgacggttattccggtgcgaactttcaaagacccggatttcaagccatgcttgcagacattgaagcagggaaagtcgggacagttatcgtcaaggatatgtcgaggttagggcgaaactacttacaggtgggaatgtacacagaaatgattttcccacagaaaggtgtccgcttcatcgctatcaatgacggagtggacagcgcacagggggaaaatgattttgccccgctgcggaacatttttaacgaatggctggtgagagatacgagcaagaaaatcaaggcagtaaaacgctctaagggcatgagcggaaagcccatcacaagcaagcccgtctatggctacctcatggacgaggacgaaaactttatcattgacgaggaagccgccccggtggtacggcagatttacagcctttgccttgccgggaacggtccgaccaagatagcccgtatgctgaccgagcagcaaatccccacgccggggacgctggaataccgcaggacgggcagcacccgccgctaccaccccggctatgagtgcaagtgggcgaccaataccgtggttcatctgctggaaaaccgggaatatacgggctgtctggtaaactttaagaccgagaagccgtcctacaagctgaaacacagcatagaaaatcccccggaaaagcaggcggtttttgagaaccaccatgagcctatcattgaccgggaaacgtgggaacgggtgcaggagttacgcaagcagcgcaaacgccccaaccgttatgacgaagtgggcttgttctccggcatactcttttgtgccgactgcggcagcgtcatgtaccagcagcgataccagacggacaagcgcaagcaggactgttatatctgcggaagctacaagaaacgcaccgccgactgcacagcgcactttatccgcactgacctcttgaccgctggcgtactctccaatctgcggaaagttaccagctatgcggcaaagcatgaagcccggtttatgaagcttttaatcgagcagaatgaggacggggacagacgcaggaacgccgccaagaaaaaggagctggaagccgccgagaaacgcatagccgagttatctgctatcttcaagcggctgtatgaggacagcgtaaccgggcgcatatcggacgagcgtttcacagagctgtcggcagactatgaagccgagcagaaagaactgaaagaacgtgccgccagactgcgggaagaactttccaaagcgcaggaagccaccgcaaacgctgaaaagtttatgaatgtggtacgcaggcacactaccattgaagaacttacccctactctgctgcgggagtttgtggagaaaatcgttgtccatgaaagcgttgcccttgacgggaaacgccggggcaagttacgcagacaggaaatcgaaatctattattcttttgtcggcaaggtagaactgcccgacacctaaccgcccgacctatccgacatacctcatgtgccggataggaacggcaaaattttttacacttctattacttctttatcacacataagcaaagtcccagggcatgaagcagctcatggcgggtggcggcatcatcgtcattggcaccacactgatccctctgctgtctggcctgttttaaggtaggcgcttatggattttctcaccgactggctcacaaactggctcaaagagcttctgattggcggcatcatggggaacctcgaaggtctttttgatactgtcaatacccaagtcggagagattgcggcacaggtagggactaccccggcggcgtggcacgccggggttttctccctgatccgacagctttccgaaacggtgatcctgccgattgccggaatggtgctgacctttgttgccacttatgagctcatacagatgcttttggaaaagaacaatatgcacgaggttgacgttgcgaacctctataaatggatgttcaaaacggcctgtgcaatcttaatcctgtcaaacacattcaatatcgtcatggctgtgttcgatgtgtcgcagagcgttatcgcgcaggcaggcgggctgattcaaggctctaccgatgtttcggcggatatgcttgccgaactggaaacctcgctggaggcgatggacttagggccgcttttggggctttggctgcagtctgcgctcattggatttacgatgaaggcgatggggattatcattttcgttttggtgtatggcaggatgctggaaatctatctgctgaccagtctggcccccatccccgttgctacgctttccaaccgggagcttggcagcaccgggcaaaactacatcaagtccctgtttgccgtgggctttcaagggctgctgattcttgtatgtgttgcaatttacgcggtgctcattcaaggcatcgcaacaagcggcgatcccatcggggcgatttggggaactgtgggctacacggttttgctttgcttcatgctctttaagaccgggagcattgcccagcgtatctttggcgctcattaacaggaggaggtgcttatgccgagaagatacggggcggatggaacgcgcttatggaatggaaaaacgccggaggagtttactgaggcggatgcttaccgctttatggtggaaacagaggccgtcctgcaaaggaaagagctgatggacgatcccgcccagcctgctccggcaagcggaaaggaggaattttatctgagtaagaaagacgatgtattgctgaccccggagcagattgctgcggaggagcggcgctggctgtttgatgctcccatcgcggagcttgcggaagtcaagggcgttagtattgacgaggcggtaaaaatgcggacggatgccgtcttgcaagaggcggttgttccgatcacagtatctgtccgcccgattgagccgcagggtaaactgatcggcttcgccagcgtcaactttggcggtgtggtcatcgacgattttaaggttgtggatgggaaaaacgggattttcctcggtgctccctctaagcccgatcctgccagccggacgggataccgggctacggttcggattcctgaccgtgccatacaggaacggatcaatgcggctggtgtggaggcgtatcatgcggcggtggaacagcttgttgcacgggcccaggcggtacggcctgccccgatcaaggagcagatggccgaggccgcgaaacaagctggaaaagaaaatgccgcccggcctgcacctgccaaagcaaaggaggcccgcaatgaccgatagccgcactttgggacaaagtgtcccgaaggagggcttgtttctcatggacggcatcgagggcctgcgttctttgccaaaacatagcgtggatatgctgctgactgatccgccctacggcacaacccggaattattgggatgtgcccctgccgctcccggagctgtgggaggcggtgaaatgggcggtcaagccgaatggcgcagtgctgtttttcgcacagtgcccctttgacaaggtgctgggcgcatccaacctcgccatgctccgctatgagtggatttggtacaaggagcgcggaacgggctttctcaatgcaaaccgggctccactgaaaaagtccgagaatatcttggtgttttaccagaagtccccggtctacaatccgcagtttacttatggcaagccttatacccgtgttcattcccgaagcggtacaagctccaactatgggaaatttgaacggcagggctccgagtccaacgatggccgccgctatcccggaaatgtactatttgtgcctacggtgtccggcggcatccatcctacacagaagcctgtggagctctgcgagtatctgatccgcacctacacccgtcccggagaactggtcgcggacatttgcgttggctccggcacaaccgcgattgcagccatcaacacagaacgccgctttgtatgctttgaaacggccccgtccttttatgccgccgccagtgagcgcatccgtgcggcgcaggcagtaaaaagctccggcgagaaaggagtgtaattatccagcagtattctatcatttacgccgatcccccttggcgctactcggctaagaaagtacagggcgcggcggaaaatcattatcccactatgagcattgaagagttatgtgcgttgcctgtggctgatcttgcggccccggacagcgcactctttttatgggctactttcccgcagctcccggaggcgctccggctgattgaggcttggggcttcacctacaaaagcgttgctttcgtctggctgaaaaagaacaagaaagcagatagctggttttatggccttggcttctggacaaggggcaacgcggaaatttgtctgctggctaccaagggacatccgaagcggcaggctaccaatattcatcaatttatcatttccccgattgaggcccacagcaaaaagccggacgaggcccgcgacaaaatcatttccctgatgggcgatctgccccgcgtggagctctttgccagacagaccccgcgcggctgggctgtatggggaaatgaagtaacaccaaccatcccggactttgggacacattgtcccgaagtgcagaaaggagtgtgatccatgccctatgtaaacgtaccaaacgatttatccaaaatcaaaacaaagatggctttcaacctcaccaaacgccagcttgtctgcttcggcagcgcgggcgcggtggggattccggcctatctgctgacccgtgccaccctcggcaataccggggcgatgtttctcatgcttggaattatgctcccggcgttcttgctggcgatgtatgaaaaggacggcttaccctttgaaaaggttgtgcggaatatcatccgggtcaagtttctaaggccggggatcagggcctaccgaaccgaaaacatttatgcgccctttaccgggccgggcgctggaaaggaggatgtgattgaaaaacacaaagaagaaaaacggagccgccgccaagggtaaaggccgggcggccctgtctgcccagcagacaatcccgtatctgtccatgcacccggacggtgtgtgcaagctcccgggtgggctctatacaaaaactgtggaatatgaggacatcaattactccgtggcatccaccgaggatcagactgccatattcagcggatggagttcatttctcaactactttgacagttcgctgccgttccagctttcctttatcaatcgccgttcccattcccgcagccgctatcaagtcaatatcccgaaagcggatgacaactataacagcgtccgggacgagtttaccgggatgctgaaaaatcagattgccaaaagcaataacggcattgaacgctcaaaatacatcacctttggcatacccgccgaggggattgcggaggctcggccccgtctggagcgtgtggaggctgatgtcatgggaaactttaagcggctgggcgttccctcggagcctatggacgggcgggcccgccttgcgctgcttcatagccagatgcatccggggagccgcgaggcgttccgcttttcgtggaaagacatcccacagaccgggcttggcacaaaagactttattgccccggacagtctcgacttccgccagtcccgcacattccgtatcggccagtattggggcgcggtgtcctacttacagattatggcatcggagctttcggataagttgttggcagaaatcttggagctggatgcggaaatgaccgtgaccatgcacattcagaccgtggatcagctcaaggcaattaagaccatcaaggggaaaatctcggacatcggaaaaatgaaagtggaggaacagagaaaggctgtgcgctccggctatgacccggatattcttccccctgacctgattacattcagcaaggacgcagcggagcttctggctgatttgcaatcccgcaatgagcgaatgtttctgctgacctttacggtggtaaaccttgctcctaaccgccagcggctggaaaacgatgtgtttaccgtgggcggtatcgcgcagaaatacaactgcgctctgcgccgtctggactggcaacaggaacagggctttgtttcctcgttggcccttggttacaacgaggtagaaatccagcgcggtatgaccaccagctccacagccatctttattccttttatgacaagggagctccgcatggctgggcaggccctctactatggcatgaacgcactttctcacaatgtcatcatggctgaccgcaaaaagctgaaatcggcaaacgggatgtatttgggctctacgggctccggcaagagctttgccgcaaagcgcgagctcttgaatgtgtttctcaccatcccgcaggatcggatcatcgtggttgacccgatgggcgaatacgctccgctggtgcgaaggctgggcggccaggtgatcgagattgccccggacagcccgcaccacctcaatccgatggatgtggagctcaatatggccgccggagaaagcccgctttccatgaaggcggattttcttttgtccctatgcgagctggtggtcggcggcaaggaaggcttgcagcccattgaaaagacggtcattgaccgctgtgtgcgtttggtgtaccgggaacaggcgctcggactggaaactgcaaaaacaccgctgttgcaggatttgtacgaagagctcttacgccagccggagcccgaagcccggcgcgtggcaactgccttagagctttattgcacaggctccctcaatctctttaaccatcctaccaacgtcaagacggacagccgtgtggtgtgcatcgttctgaaaaacatgggcgaaaaccttagaaagattgcaatgcacatcacaaatgagtttgtttcgcaggcggtggatcagaacttccacgagggtgcggcgacttggtgctactttgacgagtttcatatcctgctccgcgatccgctgacagccagctactttgtggcagtctggaaaatgctacgtaaaaaaggatgtgtgccgtctgctttgacgcagaacgtcaaagaccttttggccagccgggaaatcgagaacattttggacaacacggattttatgattctgctttcgcaggcgcagagtgaccgtaccattctggcaaaacagctcggtatttccgagcatcagctttcctatatcacacacagcaattccggcgaggggctgttgttctatggaaatgtaaccattccgtttgtggatcggttccctcgcggagaaatctatgacctgctgactacccgcccggaggatatgaagaatgaaacgaaaaacgaataaaaccaaggaggaggcttggtcgcagaccgcccacgcccctgacggggaacagcccgggccggaggcttccgacacttcgggacaaagtgtcccgaagtccaagttccgcaaaaagagccagcaggaacaggctgcggcggcaaagctccacatggagtcccaaggcgaaaaactggaacaggcccgggagaagctggcaaagcaaaagccgccgaaaaagcccggcccggtaaaacgcataggccgtgttgccagcggttccgttcacagcttcgtgcatggcaagatttttgaagtggaacaggaaaatgtcggcacggaaggcgcacaccgttctgagcttgtgggagaaaccgcgctacggcatggctctcgctttgtgcgccgtaaagtccgggaacatccggcaaaagtggtacgcaaggccgaggcccgctataccaagtacacagcggactaccattttcacaccgccgcacaggagcacccggagctgacgaaaaatacccttacccgctactggcagaagcaacggctccgcaggcaataccgcaagcaggcaaaggaggctgcaaagcagagcgcggctgcggctgggaaaactgccacagccacagaacgcctgactgcccgggcagtggaatttgtcaaaagtcatcccgcaggtgccgtgattgcggtgctctgtgtgttactcctgtttgctatgcagtcctgttcctctaccatgcttatgctggggaacgccggggccggtgcattaggagccagcacctatccttgcgaggatcgtgatatgctggccgccgaagccgcctattgtgcgctggaagatgatttacagcattatctggacacctatgaaagcacccacgactatgacgaataccacttcgatctggacgaaatcgaacatgatccctatgtgctgctttctcttttgtgtgcgctccatgagggacaatggacaataggcgaggtacagggaacgctgcaaatgctctttgaccgccagtacattctcacggaggatgtggtggtggaaacccggtatcgcacagaaaccgacacatggacggacgaggacggcaactcccatacggacacctatcaggtgccttacgattattacatctgtacggtcacgctggaaaactttgatttgtcccatgtacctgtgtacgttatgggcgaggatcagctttcccgatatgccatctatatggcaacgctggggaaccgccctgatctgttcccggattctccctatgtgaacaagtacattaccgggaaacccggtgactacgaggtgccaggagaatatctggacgatgaaatctttgccgcgatgcttgccgaggcgcagaaatacatcggctatccctatgtgtggggcggcagttctccggctacttcctttgattgctcgggctatgtttcatgggtcatcaatcactccggctggaatgttggcaggctgggagcccaggggctctataacatctgtacgccgaccagctctcccaaacccggtgatctggtgttcttcaaaggcacctatgacacgccgggcgtgagccattgcgggatttatgtcggtgacgggaaaatgctgcattgcggagatcccatcggctacgcaaatttgaatacaagctactggcaatctcatttttacgcctacgggcgtttaccgtgacaggaggttttgaaatggcaactaccaaaagcatgaaaattcaggccgagattgataaggtcaaggccaaaatcagtgaacagcaggcccggctcaaggagctggagcaaaaaaagctggaggcggaaaacagcgagatcgtggacattgtgcgcggtatgagcatttcccttacggagctcccgctgctgtttgaaaagctgaaggacggaggtactttgggacaaagtgtcccgaagtccgaagaagaaaagaaggaggaaaactgaatatgaaacactttcgtatgttggcagcggggctttgctccgccgttcttttatgcggctttgcaatcccggcctatgcctattcggacggcgggaatgaggaaccgcctgttgtggaagaaactccggccccggagccagcgcctaccattaccccgggcgagggcttttcggaggatggaaaccttgtgacccgcgatctgctctacgatgccgcaaccaacaaacagttcatcacggtggaaaccagcggcggcaacaccttttacattgtcattgactatgacaagcctgtggacgaggacggcgaacagtatcacacctactttttgaacatggtggatgaagccgatctgctggcggcactggaggccgctggcggagaacttccggcctgctcctgcacagaaaaatgtgcgcccggagccatccatacggattgcgaggtctgcgcggtcaatatgaccgagtgtgctggcacagctcccgaacccgctccggtgacggaacctgcggaggagccggaacccgagccccagcagaaaagtaataccgggacgcttctgctgattttggctgtggctgttctgggcagcggtgcaggctggtacttcaaaatttaccgcccgaagcatgaaaaagctgctgtacccgaagaggattacagcgaggaactggctgattatgacgatcccgaggacgatgggccgccttgggacgaggacgataccgaaagcgaggataatgaatgagatttaccaacaacccctatgagggatttatgaaagaaaaaagctactttaagggtgtgccgcccagcctgccgccgaagggctcccgttgtgacggctgcccttactggcgcgggatcggctgcgtgttctgctaccgggagcaactcaaaccaccgggcaacgggaggtgatgctgtgggccgagaactgacccggacagaaaaaacggcaatccgcaggctggtatcaaaatggtgtgccaactatgaccgggactgcggctgcctgccgctggattgcgagtgctatatgtttgggaaatgctggacgggggcttattgccgctacttccgcgaggcagttctgccccttgatccggcgctggaggctgcgctgctggcagaagggccaaggccggatttcaaggtttgcccggtatgcggcagagccgtggctcctgatggacggcaaacctattgttcggcggcctgtgcaaaggcggcacaccgcagacagcagcgggaatatatgcgaaaaaagcggggctgatgtgttgacaattaggacaccccaaacccgcctgtgacaaggctttttaaggcccttttctgcgggaggcgtatgtttctacgtctgcccctgtttccgtgagatgctgtcaacattttagctgccggggctttgggacaatttgtcccaaagttccggcttttgtggaaggaggtactatgccgaaatattatccgatcaatgaagaagccgcaaagcgggcaaaggatatgaacagcttttctgactatcagccgggctccgctacggcgggctaccgggcaatggtcgatgaagcgtatgcggcggcagaacgccagaaagtccgtgtcgatcccatgtaccacgataagattgacgcgctggtggatcgctatgcccggaaacttgcggaaaatctgaatgaacgcaatgtgattgatgcccgggtgccctctattctgatctccgggggcggcaatttccctgtgacaaaaaagcacaagcagaacgccgcccgggatcgcaactatggagagtatgcggagatttcaaagctgcttgataaaatccgctctgttggtatgggtgggatcagcgcagacgatgatcttgccgtggaaaaactgacaaaaaagctggaggggctggagtcccagcagaccaccatgaaggaggtcaatgcgtattttcggaaacacaaaacgctggacggttgcccggagcttacgccggagcaggcagaaaagctcaaggcagatatggcgcagtcatggcacttggacaaaagtaagccgtaccccgcctatctgctttccaacaacaacgccaacatccgccgtgtacgccagcgcattgaggaactgagcagccgctccgagtttgcaggctggacattccccggaggcgaggcaaaaatcaacgaggctgaaaatcgtttgcagcttatttttgaggaaaagcccgatgccaatcagcggcaggaactgaaaagcaacggctttaagtgggctcccagccaaggggcatggcagcggcagcttaaccagaacgccatccgtgctgcggcccggatagactttctgcggcccgaggacggtacaagcccctatcagctccagccgtttgtgaaaagagaaaacaaagaaatgtctcgatgatgggaggtgtactatggacaaaaatcaaggctacgccattttgaaggcggtcatgctggaaaatggacgaggatttgcattgggcgaacatcccaccgcgccatcccgctatgtcacatgggcctgctatgatgacagggacggccagcggcagtatgaatggggtcactatggaaatgaccgcaccgcgatggaacaggatttcacagaccgggtgcaggactatcagcgtatttataacgtcgggatcaggcagaccgaggctcccggcctttacaagtattattcgacccagcggcctgtggacatcgggacattcccgaagccgccttataacaagccggatgaaatcttcaattacgatcagcgcatcccggtggaaaatggctcgttcttggcttggggctatcttacctatacccgcccgctaacggaaaaacaggcatccgactatgagctgcgtcctgcgcctgataatcccgacaggccccgtccgattgccgagcagatgaaaaatgcggcaaagttggcggaggcagatcgcggctcggaggctccggctccccaacggaggcagcctgaccgtggcgatagataaggaggtacgtatatggaaaagaaacgtgaacaggaattgtctgtactggaggtgctgcgcctgcaccgtgaatttcatttgccgcaccctgttccggcagacgaacaggaaaagccgctggataaggtaaaggagccgccccgcgcctgccgcagccgggagcgtgaggagcgatgacaaagaaacgccgccgtccgatccatcttcatgtgatggtgtcggaggaggagcaggccctgattcaagaacgtatggcggaggctggcatccgtaacatgggagcctatatgcggaaaatggccctgagtgggtatgtgcttcatgttgacctttcgcctgttcgtgagctggtttcgctccagcggcgatgctccaacaatctgaaccaagtggcaattcaagccaacacctacggcgcgatttatcccgaagaactcgcagccttacagcgggactatgccgcgttgtgggggccgctgtctgatcttttgaaacagctctccgcgctggtagagctctgacccatccggggagtggttgataccgctccccggctttttctacttcgggacaaagtgtcccaaagtaaaaatactgtttgccggaaggagggatttctacggcgaccacctacatccgcccttataaaacagcggcgggaaaaagtgcaattcaaacgatggaggatcgtttcacctatggcctgaacccggaaaagctgggagccgtatcttcctatctctgcgatccgaacacggctcccgccgagtttcttctggtaaaaagtcaataccatgcagagacaggccgggccgtatctcgcggggcactgttctttcagatccggcaggcgtttctgcccggggaggttacggtggaagaagcaaaccgtatcggttatgaaacggcgatgcgctggacaaagggaaagcatcaattctttgtctgtacgcataccgataaggcccatatccacaatcacatttattttaacgcaacggcctttgaccgctcccggaaatttcataatttcattggttcgtcctttgccctgcggcggctctctgaccgcgtgtgcatcgaacatgaattgtctgttatccaaaatccgtgccagcacagcaagggtcgttttctccactatggacagtggatcggagaaaagccaccctctgccaagcagcgggtgcggctggctgttctcgccgctttggagaaaaagcccacggactttgccgactttcttcgtctcatggaggagtccggctttgcggtgaaacatgggcggggcggtgtcatctcattccttgcacccgggcaggaaaaaccgacccggctccgggcttctacacttggagttggatttgacccggaggacatcaaggcggtaattgccggggaacgtccactccccgaactgcccgaggagcccacggttccgccacggcgagttaatctcatcatcgacattcaagagcgtatggcccaaggcaagggcccggcctatgaacgatgggccaaggtctacaacctaaaacaaatggccgccgcgctccagtatttgcaggagcatcatctgacagactatgcggcactgacggccagcaccgaggctgcggtggatcactttcacaagctgtctgacgagctccgcacaacggaggaggctctttccaaaacctcggagctgatggctgccacggtggactatgccaagactcgcccggtgtttgatggatacaaagctgcgcggtacagcaaaaagtatctggcccagcacgaagcggagcttgccacttaccgggcggcaaaggatactatgaacaccatactgaacggcgcaaaactccctaagattgaaatactaaaaaaatcccgccgtgagctggcgggacaaaagaaagagctttatgcagaataccgggaagcccagcggcaaatgcgggaggccgtggcggtaaaagcgaacattgatcatctgctcggcataacagacgagcgtgaaaataaggcccaggaacgatagtgacgggccgcagactacggtgcagcgcaccgggactttgggacaatttgtcccgaagtacagcgggtttggggagctccccaacaagcatttttgcgggccctgcgccctgcaaaaatttcggagtgtggccacacccgaattgcttgccaaaacgcgcaacccgcaacatggcgcaaaaaacggaggttacgctttcttttacgtttcctccgtttctttcgatgctttcattgcttggattgtagcttcaacgattttcaattctctttcgtccaaggcgttcaacatggcatcaatccgctttctgcactcgctcccgctattttgggacgggtaaaagtattgatccaccgatatatcaaacattgtgaccatctgataaaaggtgttgaggcttggatgctggccgtcattttcgttatacataatggtacgcggagcgcggtcaacaatataggccagttgctcctgtgtcatgccgctggcttctcttgcacgcttgatggcgagccctatatcgtgaaaatcaaagcgtctttcatctcgttctatcttcataacatcacctgatatgattttacatttcatgtgatattatttgaacgattgtgtatttcatactactgactatttaatttcatattcttttcttcccaaacttgtattgttcgagtcgaagaactataatatactctatggaggtgcagaatggattatatgacactaaaagaggccgccgaaaaatggggcgtgacacctcgtagagtaaattactattgcgctgctgggcgtatccccggcgctgtaaagatggcaactatctggctaattccaaaggatgcggaaaagccgattgatggtcgaacaaaacaaggaaaggcagaaaagtatgagtaatatattacttcttgaagatgatctaagcctgatcaacgggctttcttttgctttcaaaaagcagggatttgaattaaatatcgccagaacgctcaaagaagcggagaaattgtggacagacggaaaatatgatttgttggtgttggacatatctctgccagatgggtctggctttgacttttgcaaaagagttcgacttacatcaaaggtgccaattatttttctgacggcttcggatgaggaaacaagtattattatggggctggatattggaggtgatgactatatcacaaaaccgttcaaactgggggttctcgtttcaaggattaacgccttacttcgacgtgcaaattcttttcaagcagcagacacagaattgcagtcgaatggcatcaaggttcttttgctgcaaggacaggttttcaaaaatggggtgctgttggatttgactgccgcggaatacaagctactgtgcttgtttatgcgaaacccaagcatggtgctgacaaagggacaaattttagataagctatgggattgcgacgggaattatatcgacagtagtacccttacggtctatatgcgtcggcttcgtatgaagatcgaggataatccaagtgaaccacaaatgctcctgactgttcgaggtatgggatataaatggaatattatcgggtgaggtgcagaatgaagatactggcaaataaagaaatcaaaaatctatttctttcgctttcactggtttttgggattacatttctcttagccgaggtttttctgtggctgtcatatcgccggctttctctgttattgctaatcctttttctattggctggcggtgctgtatgggcagtctgctttgtatattttaatcggcaaaatcagatcatggagcaggcgatattacaaatcaatgcgtatcttgatggtgatcgcaatgcccgtattgaatgtgacaatgagggcgaattgtaccgtctgtttcattccatcaattctttagcggcagtgttaaatgcccatgcagataacgagttgcgagagaaagagtttttgaaaaatacaatctccgacatttcacaccaactgaaaacaccactggcagctctgaacatttataacggactgcttcaggacgaggatatagaagtgtcctctgtgaaagaatttgctaatctgtccgagcaggagttggaccgtattgaagtgctggtgcaaaaccttctcaaaatcacaaagttggacgctggttctattgcatttgaaaaggaaatagaaaatgtagcggatatgatgcaggatttggagctacactttgcatatcgtgccaagcaggaacagaaagaaatcgtattatctggtgcagatgatatttctcttttctgtgaccgtgattggttgggcgaagcgattggcaatattgtaaaaaatgcacttgaccatacaggaaagggcgataccatttacatcaaatggacggcactaccctccgctgttcaaatcacaataaaggataacgggtgcggaattcatccagaagatttacaccatatcttcaaaaggttttatcgcagccgtttttcaaaggatacacaggggatcgggcttggcctgccgttggcaaaagcgattatcgaagctcatggaggcctaatagaagtggaaagtgaattaggaattggaacgagttttataatgaacttcccaattcctacaaaattgtaggctggttgtagggctacagtaatattagggtgctattctttccatcgtaaacaggaacgaaagtttacccgtttacgacagcaaaatcattgagaaagaggtgtttgcacgatgaacttattagaagtcaaaaatatttgtaaaacctatggcagcggagaaaccacagtcaaggctttgaaagatgttagtttttctgttcccaaaggagaatatgtggcaatcgttggagaatccggttctggtaaaagtacgttgctgaatatgatcggcgcattggacacgcctacgtcgggtaaggtattgattgacggcaaggatattttttctatgaacgacaagaagttgaccgtcttccgtcgcagaaatatcggatttatttttcaggcgttcaaccttgtgccagagcttacggtagagcaaaatattatttttcctgtactgcttgactatcagaagccggacaaaaaatatctggaagaactgcttactgttcttaatctgaaagaacgccgtaaccatttgccgagccagttatccggcggccagcagcagagagtggcgattggccgcgcattgattacccgtccttctctgattctggcagacgagccaacaggaaatttggactcacaaaacagcagtgaggtcatagcattgctcaaagaaacatcgaaaaaatacgagcagaccatcattatgattacccacaaccgcagtattgcgcaaacggcagaccgggtattacaggtatcggatggtactttgactgattttgggaggtgccgtgaatgaaaagctatcttagtcttattcccatctccgctaaagttcaccgccgacaaaatcgtatgacgctgctttgcattgtatttgctgtgtttatggtaacagcagtattcagtatggcagaaatgggttttcggatggaacaggcccgattggttggtaagcatggaagtttctctattggagacttgctcggcagttccatggggcaaacccttctttctgttgcggttgttctgttcctgctgattttgattgcaggcgttttgatgatttccagcagcatgaacagcagcgttgcccagagaactaaattttttggaatgatgcgttgcattggtatgagtaagcagcagattattcggtttgttcgtctggaggcattgaactggtgcaaaacggctgtacccatcggtcttgttttaggggttgttactacatggggactttgcgcggtactgcgttttgtagtcaaagaagaattttctgatattcctctctttggcattagtatttttggcattgcttgcggtatctttgtgggactgattactgtactgattgccgcaaatgctccggcgaaacatgccgcgaaagtatctcctatcacagcggtgtctggaaatgcagaccacggaaaaacaatgcatcattgccagtatacaggattcggaaagattgaagcgcttctcggtatcgaccatgcggtctccgggaagaaaaatttatttctgatgacaggttcttttgcacttagtatcatcttatttttgagtttttccgttatgatcgattttgtggattatttgatacctcagtcagctgccacatcagatattgatattgcaagtgatgacggtaatgcgattcctcgggaattgcttacatccatccgtgcaatggatggagtgagagaggtttacgggcggcgtagcgcgtttgatgttcctgccagattaaatagcgataccggattttccggtacaaccgacatgatttcttatgatgattttgatttacaatgtctgaaaaaagacagtgctttgaaaagggggagtgatctgtccaaagtttttggggacagcaattttgttttggcaacatccgatcaggacagcacatggaaaatcggtgacactgttcagattggggatgaaacccttaccatagccggactgttaaaaaacgacccatttagtgagaatggattgacaaatggaaagctcacattgattacctctgatgaaacatttgtccgtttgacaggagaggaaggttattctcttgtgctgatacaaacaacgggagatgttacggacgaaaatgttcaggcaatccagaattccgtagatcaaacatatagctttcgagataaacgcgacgagcgcactacgggaacttatatggcttttgttttctgtgtttatgcgtttttggcaattattgcactggtaacggtaatgaacattgtcaatagcatttccatgagtgtgtctgccagaatgaagcaatatggagctatgcgggcagtaggaatggatgaacggcaaatgacgaaaatgattgcctgtgaagccttcacctatgctgttttggggtgcgttgttggttgtgctattggcttgccgcttagcaaatcgctgtatgatttccttattgcagggcattttccatctgctgtgtggcagttcccaattatctctttgggcattattcttctgtttgtctcgattgcggcaatcgcagctgtatatgctccggcaaaacgaattcgcaatatgtcgattactgcaaccatcaatgaattatagtttcatatgttaatctgccgcgcgacggcaaaagaaaaaaagccgtcgcagagcagacacattttcacgcgcctatgaaacggcggctttgattttcagagccgccgtttctttgcgtttacacaatcctatgacgacttgcagggacacggtagccgattggaggttaatttaccgtgtccttctttttgtttcgcagtatccatgatctgcaccagctaaaaaaagcgtagcccctccatcggagcagtccggctttgaatgtgaaattaaacagtacataaccgataatatattttcatgcgcttgtgcggctttgtgtcgcgcaggcgcattttgctttccagacttcgagacaaagtgtcccgaggtgcggtgccgttctccgccgttactccatttcgtttccgaccaaccccgaacaaactgaaatggaggattttacgatgactactatcaatctgaaagatttttattattggtacacgcaggatcagcttatcgaagtttctgacgaggtggccgaggtattcaaggccgatgcccgctatgaaatggcctaccagcggcggctctcccggcacaaggcgcagtattctttggactgcgatgacgggattgaatattccgcttgcctgcatgagccgaccccgcaggagctccttgaacgaatggaaacctttcttcgtctgtggaacgctctcaattctctgccggagattcagggccgcagaattgacgcacatatcattcttggcaagtcgattaaggaaattgccgaggccgagggcgtacatgaggagtctattcgccagtcgatcaagcgtggccttgaacgcatgaaaaaaactttttgattttttcatcttaacccacttggaattgatgaaaaaatgtctcggtttatgagaggaggttttcttcctaacgcaagggaataacggcaaccctgagtaagttcggggagccagacggtgggtgcgcggtgacatttccaaaaagagattgagcgaacaacaccaacatcgtaaatgagcccggccatcccaaggccatgatccggcgctgaacaggttggctgcctgttcctccgggcgtgtcgctttacttgcgttgagagcgccgcacagaaaataaagattgtctttggacaggccaagtaaatatgtgcggcgctctctaatattcaaaaactataataaacctcgagacaaagtgtcccaaggtggagtaaggcaacaggccagcatcccagtggtgctggcctgttgcgtttccctaccaaacagagggaggcgttctatcaatctgcgaaggaggtttaccgtgaaattaactacacaggaacttgaacaaatgagaagcgttgacattggcgcggtggctgccgagtccctgcctgatgtgagcggtatgacctttgacaatgcgctttcccgaaaggagcgcatcactcgatttttgcagactgtcaaaaatccatactgcttttgcatcggtggtgttggcgtgaaaattgaatttgctgaaagcgggccatctctccaagataagctgacggatttcctgctgcggcaaagaagcgggctgtaacttcggttacagctcgttttgcttcttcgagacaaagtgtcccgaagcggaggcatccttgttgtcctccccggacagagttataatataagtgtaatgtgatagggaaggaggaacaatggcacgagcaaaaaacagagggtatcagcagagtttctctccctcttacacaatccgccgctggcggctgggcatctatatccggctttcaaaggaagatttgaaaaaaggaaaagacgatagcaacagcgtaaagaaccagcgtgacctactgaacgatttttaccgacgaaacattgacgagtttgaaagcatcacggaatatgtggatgatggtcatactggaacggacgccaaccgtgaagattttcaacggctcttggcggatgtcatgagtggtaaaatcaactgcgttatagtaaaagacctgtcccgcttcgcacgaaattatagcgatgccggaagtttgatcgataacctgtttgttcaaatgggtgttcgctttatcagccttgctgagaatgtggacagctacaagaaccccgacagcgtttcaaatatcatcgttcccattacaaacgtgatgaacgataattactgctatcagacttccaaaaagatccggcaggtatttgattacaaacggcgcaacggccagtatatcggagcatttgctccttacggctatgtaaagcacccaaaggacaagcacaggctgattgttgatcccgatgctgctgaaaatgtcaaactcattttcacaatgcttattcaagggtcatcaaaacgtgctatcgcgctgtacctgaacgaacacggcgtaccgagcccctcggcttacaaggtacaaaagggcttgcctgtttcgacaagagggtatgacgatcctatgtggggagtccgcatgatccactccattcttaccaatccgacctacaccggggatttagcccaaggccgaagccgggtgaaaagctacaaggtacaccagattgaagctgttccacgcgaggaatgggtggaagtggctggaacgcatgaggccattatcgactatgaaactttcgacaaggtacaggctctcttacagcgtgatacccgtacttccccgaaaggccgtgaggtacatttattcagcggctttctgaaatgtgccgattgcgggcgggccattacccgatgcgttggcaagaacaacaatgtatattattcttgctcaacctacaagaaccgttcccggacagcctgcaccatgcactcaatcaagcatgaacggctggaggctgctgttttgttcgctgtacagcatcaggtacatttggctgtttcctactcggaaatcgtcacgcagatcaattccgctccaatcaaaaaaagccagtcctaccgactggacgatctgatagctgcaaaagagcgggaactgacaaagataacacgctacaagcaatctctttatcaggactggaaagacggtgaaatcacccagcaggaataccgggatatgaaggctgactatgaacggcagacttctgatatttccgcggtgcttacccggctgaacgctgaacgcgcagaactggcaaacggtgtggacaacgagcatcctgcactggtagcctttatgaagtatcagaacattgaagccctcaaccgtgaaatcttggttgaacttgtggactatatcaaggtctatgaaaacggcaatatcagcgtgaaattcaaattcgctgacgagctccgcaagattgccgagtacattgaaatcaacactacggaagataccgcagtagcgggctaacccccgctacaaacccctttgacagtgtgttttcctaataggcgctaatcatatgctgttggtataataaatagtgtgttgagtacacgagtccgcaaatgcgcggacgatatttttacacaaaaatgtacacgtgtacgcaaaacagaaaaaatcacaacaaaacaatgtatggggaggaagtagtgcaaaaatgcggacgatactgcattttgcacagggctgtttgatgcggcagacaccacaaaatgagcccttatcgcagagcaaacgagatggaagacacgttacgggtgcagattcattgcccgtgcaaatcagaggttgcatctgtggttgcctcgacacaaagtgtctgcagaatggaggataacatgaaaaaaagagcaatggcgggattactggcaatgacaatggcagcgaccatgtttgcagggtgcggcagcacagcagcagacagccagacagcggatgcacaggggagtgcaggcacggcaacagaggcagcaaagacagaaaaagacagcggaagtgctgcgggagaaggaatcacattgactgtgtgggcaccatttaccggatcagacggagatgtgctgcgtgaaatcatcgacaactacaatgaaaccaatacggacaatattacggtgcagattgatattatggacaatgataccttgcagacaaaatttgcaacggcagtatcgaccggtacaggaccgtcgtttgtgctggtgggcattgagtatcttcatcagtatgaggagaatggactgatcgaggatatcagcgatttctgggatacgatgggcattgacaagagtaatttctatgaaaatgtacttgcaaaatcctacatagacgatgcgctctacggcgtaccaatgcagtacaatgtgcagtatctgtattacaacaaggatcttttcacggaggcaggtcttgatccggagaacccgccgaccacgctcgatgaattgcgcgaggcggcgatcgcctgcaccgatccgtctaagaatcagtatggactgggacttccgaccgattacggttattactgcgagtacctgtgggcgaacggcggagatgtcatcaatgaggatgcaacacagaaccttttaaattccgaagaaaatattgcaaccctggagtggattcagaagcttgcgacggaggatggggtatccccggagggactcaccgcagcggatgcggacacgatgttccagtccggccagcttgcaatgtataccagcggtccatggaacatcaacgggttgacacagcttggtttgaattatggaatcacggcgatcccgggcggaagcgacggcgcgtactccccggagggcggatgctcttacatgctgacgaaaggggccgacgaacagaccaaagaggcagtgtataaatttatggcatactggctgtctgatgatgtgttaaaagagtggtcgaaccggaacggcttcccggtatggtcttactctgttcttgaggatgcggacattcagaacaacgagatcttaagtgcagtatccaaggcatccgagatcggacgtgactggcatctgggactggaatgcggaagcatgattgacaatgatgtcatgaaaccgatgatggagaaaattttatccggggcagacgtgacgcagagtgtacaggaggcttcggacgcgctggacgcggtgatctccgactgatgtctgacggtcactgacgcaaaaatagctgcaagctgtaaaggatggaaattatgaaagtaaaaaagagacaacaccgtatggagcatcaggtgaaggcgtatgcgtttatcgcgccttccctgctcatacttaccgtatttgtatttataccgctggcgggagcgatcgggatcagtctgatgaatattgatatttatatgaaaaatatctcgttcgccggaatcgccaactacatcaaaatgtttcaggatgagcgtgtggcaaatgctacgtttcatacattttatttcgcactgcttgaggtacccctccagatgatcgtggcgttgctgctgctcatgtttatgctgcgcaatacaaaactgcacaagcttttgagaaccgtattttacctgccctatgtgtgttctatgacggcagtcagcatcatgtggtcgatgctgctcaatacgcactacggaatgctgccatatctgcttggaaaaatcggtatcacgatgccaaacatgctctcaagtacgacatgggcgatgcctacggtgatttttgttacggtgtggaaagggttcggatatacgcttaccatcctttcggcggcggcgctcggcgtctctgagtcgttatatgaggcggcggagattgacggcgcgaccgggctgcagaaatttttctatgtcacaatacccggtatacgggatacgatcggtttttgcgtggtgacgacgttaattatggcgctgcaggtattcgatcagatctacgtcatgacgggaggcggcccgcagtacgcgaccgagacgctcgtgggttatatctacaaccggggatttcagacagcgccgtatgatctcggatatgcgtcagcaatcgccgtttatttgttctgcatgattgcgattataaccgtgatcttaagaaaatatgctttcccccagggaggtgacgagacatgagaaaaataagtgcgcagcgggtgatcggaacattggtacttctgttgtttgcagcgctggtgctgcttccactgttctggctcggcgtatccgccttcaagtcggatgcggacgtcatcaagtggccgccaatctttttcccgacagagtgggtcacaacacagtttgcctatgtgtggaaagtgctcccgattgccagaatgctgcttaacacggttgtgtttgcagggggtgtcaccatcatcagtctgttttttgattctatggcagcatatgcatttgcccgaatgaaatttacaggaagaaaactgctctttggaatcatcctgctcacgatgatgattccgtttcaggtggtgatgattccactctatatggaagaatataagcttggaattttaaatacgttcttaggactgattctaccacgcgcagcgagtgcctacggtattttcatgctgacctccttcttctcgggcataccaaaatcgctggatgaggctgcgaaaattgatggtatgggagagtggaaaatatatctgaaaatcattctgccgcttgcaaagccggcacttgtgacactgggaatctatcatttcatgaataactggaacgatctgctttatccgatgatgctgacaagttcggtggaaatgcggacgctgtcagcaggacttgcaattctggttggaagtaattcgatcaaatatggtccgacacttgctgctacggtgattgcgattctgccgctgttactgctgtttttgttcggacagaagtttttcatggaaggaatcgcaacatcgggaatgaaagaatagaggcagaggagagagaagatgagacatgtgacaattaaagctgatacggcatttacaaaaggcaggattgacgaccgtatctacggctccttcgtggagcacatgggaagagtggtgtacaccggcatctacgagccatcgcataagactgcagatgaaaacggattccggggcgatgtgctgcagaaggtaaggcagatgggggtcacggcggtgcgctatcctgggggcaattttgtctccaactatgactggcgggacgggatcggacctgtggagaaacgcccgaggaagcgggatctggcgtggaaaagtattgagacaaacgaggtcggtctggatgaatttatgaagtgggcggatgcggcagaggttgcaccgatctatgcagtgaatcttgggaccaagggaatcgaggaagcgcttgcggtgctggaatattgtaatatggagaccggcacatactacagtgatctccgggcggcaaatggacatgaaaagccgtacggcatccggacctggtgtctgggcaatgagatggacggagactggcagatcgggcacaagacggcggaggaatacggcaggattgcctatgagaccggaaaggcgatgaaaatcttagatccatccatcgagctggtggcgtgcggaagttcgatgtccacgaatccgacgttcggtgactgggaacagaccgtactggaacattgttatccctgcctcgattacatttccctgcaccagtattacgggggacaggagaagggcacgtcagagtttctggcacagtcgctggatatggagcgctatatcgagacggtcttaaacatctgcgactatgtgagggtaaaaaagaaaatgtcacataagatcaacatctgttttgatgagtggggcgtctggtcgatgagcgacgtgcaggtgcagaaatcggtggaggatgcaccgtggcagacggcacctgcgatcagcgagcagatctataccatggaggatgcgcttctgtttgcaagtatgctgatgaatttcataaaacgggcggatcgtgtgaagatcgcctgccagtcgcttcttacgaatatcagctcctgcattatgacagagaaggacggcggtgtgtgggtgcagccggtgtattatccgtttgccctgatggcgaagtatgcgcacggcgtgacgttagatacacggtatacgggagacacctacgcgtgcagcacgtttgagacggtaccctgtgtggatcatgtgctcgtctatgacgggcaaaagcatgaagtgacggttttctttgtaaaccgtatggaggagagtgccgaggcgaccgtttctttacagggcatggagccggaggcggttttaaaaagtattgcactgtttcacgaggataagaaagcgacaaatcaaaaggaacatgactgtgtaacacctgtggaactggaaaacgtctcctgcagcggaaacgaaatttcagtggaacttgtacctctctcttttcaaatggttcagattcgattaaaatagaagaaagttttttgaaaagaaagaaaacggggagcaggaaaatatggcgatcacgacaaaagatctggcgcagttgtgcggcgtttccagaacaacgatacaccgggcattaaatggaaccgggcggattaagccggagacaaaggagatgatccttcaggtggcaaaggaacacggctaccggccggatctccttgccaccggactggctaagggacagacgtacaacatcggtgtcgtcgtgctggacgtgaagaaccgctattttgcccagatgctctcgacgatcagcacggaggcatatgcccgcggctacggcgtcaacattacgctgcacggcggggatgccgggacggagcgcgagcagctgacaagacttgcggattaccgggttgacgggatcatcctctcctcggtcaacgagggggaggcgtaccggacattcctggagtccctgcaccgcccgattgtctctgtggataaccggattgcggacggcatcccgtttgttgggatcgaccagcgggcagcagtgcgggaggcagtgcagagagcggcagagaagggctatgagcgcatcgtgtttgtctgcccgccgttagatacaaaaaaccggcagaatctgtatgttcacaaggagcgtctgctggggtatgaggaagagatgaaacgctatcccgcgctccggccggagtgtattctctcctgggattacctgcagaaagtggatgccatattaaaagaaggaaagcggacggcgtttgtctgtaccgcagatgagtatgcacttgagatcatgaaggatcagaagcgggcaaaaagaaaggcgccggtggattacggcattaccggatttgacaatatcgatacgctggcatatgtgacaccgcagctttccacgatctccaatgtggtggatgaggtggcaaaaagtgccgttgagatgctttttgccatgatagacgctgaaccggaagtggagcagatgacaggagacagtcagcggattttacctcatcgctacctggagggagagacgctgtagtgacagaaggatatagtatataatcagaatataattcaacaattcggttaaagctgcggaaatcagactgcctgtccgaggcaggtgcggatgtcgtccctggcgttgctgatggattttaagtggaacgtgtctgtcaggtattgcaggacattcggactcaaaaaggcgggcagagtgggaccgagataaatgtcatggatgccgagacttaacagagcgagaagatcagcgacggctttctgttcataccaggaaataatcagcgagagcggaagaccgttgacatccgtgccaaatgcatcggcgagagcagtggcaatgcggatggcagagtagacatcgttgcactgtccgatgtcgaggagcctcggaagacccgccacctccccgaagtccagcttgttgaagcggtacttgccgcaggcgagggtcataatgaggcagtcctgtggaaccatctcggcgaattcggtgtaatagttgcgtccggggcgcgctccgtcgcagccgccgatgaggaagaaatggcgcagttttccggattttacggcatccacgatcgcatcagcatagcccagtgtggcgtggtgaccgaagccgacgaggatttcctgtacgtcctggtcttcgggatagccgccgagttccagtgcctgctctatgatggcgctaaaatccttttcgccgttctcgtttttgccaatgtgcttcacaccgtcccagccgaccacatttgtgctgtagatgcggtctttgtaggagtcgcgcgggcgcatcaggcagttggtggtcatgagaatacagccgggaagattgtcgaactgtttctgctgatcctgccaggcaccgccgaaattcccggcgaggtgcggatatttgttcagccccggataaccgtgacagggaagcatctctccgtgggtgtagatatggatgccggttccctccgtctgctttaaaagcatttcaaggtcttttaaatcgtgcccggagacgatgataaacggaccttttttcaggtggacattgactttttgcggggctgggttctgatagatggtcgtgttggcttcgtccagttttttcatgacttcgattgccatctcaccggtgcgcatggtaaggcggatcagttcctcgaccgacagccggtcgtccgtgagggcttccagggcgagaatatagaaatcatccgcctcatcgctgtaatagccgagctctctcgcctgatgcccgtaggcgctgatgcctttgagtccgtagagaacggtctgacgcagggaccggatgtccggatcgagcgacttgtcatacatgataccggcgatgggcgcgtcgcgcagcatctcggttttggtctgcggaagatcgtaggtggcgtgaagcgtgggctgactgggagcgcctgcgtaagcccggagttcttctttgatgcgctgggattcgcgcaaaagttcgacatgtacttccacgtcaaaattaacgttcgtaagtgtggtaaatagcacattttcgatgaagctgacaacacttttatccataggagtgcctttttcgatcagaggcctggcatagcagctgatgcccttgatctgaaagattaaaagatcctgcagatttgcgacttcgggagtttttccgcatacaccgagcttggtgcagcctttctggttagcagtctgctcacactggtagcagaacatttcgtaatcgagttccatattatttcccatgttgatttctcctatttttattgatataccgggtaatccgtattgcgacaggcacagtatgtgcagaatatggaaaaaagatgcggcagagccggatataatgagaaaacttatcagcaaccccgttttcatttcagatcgcagtgctataataaaaacaggattagatataactaaccccgaacatgcaacgatcagaaaggatggcattatgggaagatattatcgattatcaaaaaagctgacagaggatgagagcagggaagtacagcgggagatgagagaaatcgctgacgtggaggacgtctcgatcaaagcagacgagcggatgctttttgtcgtcacaaaggacggacagttttcggatgtgatgagccgggcagtcaatatctgcagccgcgtggcaaacggagcggaactttcattcgcacgttttgcggaggcatagattcggaagagagcgtgccgacagacaatacgcggactttttagtgttcctaacatcaccgcttcacagacaatataaaaccgcgcgaaccgaaactcgttggcatctgctattgaaagcatggcagatgccgactcagacatcggcttcgcgcggttatgttttgttcattagtgatgtaaggaacacacaaaagtccttgaattgtctgtcggcctgcggacacacccgcggagtgctcaaaacttggaaaaacacggattatcgcagatgtaaaaagcggcagggttagaaattccgtattgtgcgatccgaatttccccgcctgcttctatccggaatgcggtcgcacgccttctgtaaaaatgagaaacaatctcaatagcggggcgatttctctcttgctttcttcacggtttcgttctagaatgtggttgaatcatatcctaccttacaactaggatatgaaagatgtgtgggagcgtcgcaaagaaaaccaaaagggcagcggagggaatcgtgaaagaggattccgtctgcagaaaacgcttcagaaacggaggcagctatggcagagcagattttacaggtagaagggcttacggcgcgcgtggaggataaggtgatcctgcacgaggtcgggcttacgataaaaaaaggagagacgcatgtgctgatgggaccgaacggtgcgggaaagtcgacactggggtatgttctgaccggcaatcccaaatacagcgtcacagagggaaaaatccttttcaagggaaatgacatcacggaggaggcggcagacaagcgcgccaaggcgggaatgttcctgtcgtttcaggaaccgctcgaggtgccgggactctccctcgagagctttatccgcagtgcattgagcgagcagggcagaaataaaatgcgcgtctggaatttcagaaaagaattaaaagcggcaatggaagtgctgcacatggatccctcctacgccgggcgggatttaaacgtgggattttccggcggtgagaaaaagaaatccgagatcctgcagttgatgatgttaaaaccggatcttgccattttagacgagacagactccgggctggacgtggatgcggtgcggcttgcatccgagggaatccgcgagtaccagaaggagaatccggacggcgcacttttaatcatcacgcacagcacgcgcatcctggacgcgcttcatgtggacgcaacccatatcatggtgaacgggcatattgtggcatccggggatgcatcgctggtggataagatcaaccgcgaaggttacgaggagtatgagaagctggcacaaaaaggagaggatgagcggtgaaagagaagacatacgtagaagacattgaccgcagcatatacgatgtgaaggatgaggaacgggatgcttacaaggtcgatgagggactgaccgaggcgatcgtcgagcagatctcccgtgaaaaaaaggatccgccgtggatggaactgtttcggcttcaggcactgcagatttacaatgagatgccggtgccggactggggaccgtcgattgaggggctggatatgagccatatcgtgacgtatgtgcggccgaatacaaagatgacggcaaagtggtcggatgtgccgcaggacatcaaggacacctttgagcggctcggtatcccacaggcggagcgcaagtcgctggcaggtgtcggggcgcagtatgactcggagctggtgtatcacaatgtgcgggaagaagtggcagcccagggcgtggtctacacggatatggagagcgcgttaaagggcgaatacgcggatatggtgcaaagccactttatgaaactggtcaaaccgaacgatcacaaatttgccgcactgcacggagcagtctggtcaggcggatcgtttgtctatgtgccgccgggggtgtcggtgacgattccgctgcagtcctatttccggctcaatgcgccgggagcagggcagtttgaacacacgctcatcatcgtggacaaaggggcgtatctgcattttatcgagggctgttccgcaccaaaatacaatgtggcgaacctccatgcgggctgtgtggaactgtttgtcgaggagggcgcgacactgcgctattccacgatcgagaactggtcgaaaaacatgtacaatctgaacaccaagcgggcgctggtcaaggaggggggacggatcgagtgggtgtccggctccttcggctcccatgtatcgtatctctatccgatgagtatcttaaagggaaaaggggcgcacatggaatttacaggcatcacgtttgccggaaaaggtcagaatctggataccggggcaaaggtggtgcatgccgcaccggatacctcctcgtacatgaacaccaagtcgatctccaaggacggcggtatcagcacgttccggagttccgtgagcattacaaaggaagccgccggcagcaaatcggcagtttcctgtcagtcgctgatgctcgatgacatctcaagatcggatacgattccggcgatggacatccgcacaggagacgcggatgtgggacatgaggctaaaatcggccgcatcagcgatgacgccgtgttctatctgatgtcccgcggtatcagcgaggaggaagcgcggtcgatgattgtcagcggttttgcaagcaacgtgtcaaaggaactgccgttagagtatgcggtggagatgaacaatctgattgatcttgagatgaagggcagcatcgggtaaaggaggagcttatgacaaaacagaatcagacgatcacagtcaaccggcttcctgcaaagacctggaactggctgaaaatgaatgaaaccgtgattgggatgccgcggatcgacggcagtatagcgataaaacagagtgtggcagaagcagggcaggcagaggcagagcagctgcggatggcgcagcagacggattgggataaaatcacaaccgggatgggcgaggcgatggatcagccgtcggagacagatgcggcatgggataccgagcttttgacgattccggaaaatgcagactgcggcgaaccgtatgtgtaccgttttgcttaccggagcgggcagcacgcctataaccgcctgcatatctatgccggagcgcacagccgggcaaaaataattctgctctgcgagagcgaggagacgggcgggatgatgtccgccatccagacgaaggtatatgccggggagggcgcgaaagtagaactgtatgtggtgcagacgatgaatgcggaagccgtctgcctgcatgatgtgggtgtctcgtgtgaaaaagatgccgctgtgaaggaagtgcagctggaactgggtggcgccgaggtctatacgggaacactgtttgaacttagcggagaagagagcacggcagaactcgtaagcggatatctgggcaccggcaggcagaagattgatatgaattatgtcgccagacaccgcgggaaaaagacgaagagcaatatgcagatatcgggcatcttaaagaacgaggcgaagaagctgctgcgcggaacgatcgattttgtgcacggctgtgtgggagctaagggagacgagaaggaggatgtgcttcttgtcggtgacaatatggtcaaccagaccatcccgttaatcctgtgcgcggaggaggatgtggagggcaatcacggcgcttccatcggtaagctcgacgagaacatgctcttttatgccgccacgagaggcattcccccggaggaggcacagagacttctgacactggcgaagatcgaagcgataaacagccagatcccgtcagaggaggtgcgcggcgctgttgacacttatctgaaggagcaatgcatatgacagattataaaaaagattttccgctgcttgcggaaagcgatatcgcttacctcgacaacgcggcgacagaacagcggccggcgtgcgtgctcgatgcggagcgggaattctatgagcgctggaatgccaatccgctgcgcgggctctatgagctgggcgtggaggcgacagagcagtatgagcatgcgagagagcgcgtcgcacggtttgtacatgcgaagagtgagagagaaatcatttttaccagaaatacgaccgagggcatcaatctggtggcgtacagttatgcgctgtcccggttaaagcccggggatgagatcctcgtcacgatcatggagcatcacagcaacctgcttccgtggcagatggcggcgagacaaaccggagccacacttaaatatctggagtgtgaaccggacggcagttttacggaggagaaaatccgtgacgccgtcacaccgcacacaaagcttgccgcgctgacacttgtctcgaatgtgcttggacgggcgaccccggcagaaaaactgatcgggatggtacacgaaaacggcggtgtggtactggcggatgcggcacaggcagcgccgcatatgccgatcgatgtcacggcacttgacgtggattttctggcattttccggacacaagctgatggcgccgatggggatcggtgtgctctatggaaaacaggaacttttagaggagatgccgccgtttctgaccggcggggagatgattgaccgtgtgacgagagagggagccgtatttgccgaacttccccataagtttgaggcagggacggtcaatgcgggaggcgcggccgcgcttgccgccgcgatcgattatctggaatccatcggctggaaagaaatcacggagcgcgaggagatgcttaccgcccagctgcttgccggaatgaaaaaaattccgggcgtgcatattctgggaagcggggacgaaaaggagcactgcggaattgtgagctttaccgtggatgatgtacacccgcatgatattgcatcgatcttagatgaggcgcacgtcgcggtgcgggcgggacatcactgcgcccagccgctgttggaatggctcggcatttcgtcctgtgccagagcgagcgtggcattttataatacgccagaggatgtcggacgatttctggatcagctggcacaagtcaggaggatgatgggatatgaataaccggacattttataatgaggtgctgacggatcacaaccgctatccgggtcacaaggagaagcttgcggatgcgaatctggtgcttgagggtgtgaatccgagctgcggggatgatattgtgctgcagctgcgcgtggaggatggcaggattgcggagggaacctttacgggcgacggctgcgccatctcacaggcttccgtggatatcatgctggatctggtcatcggaaagaccaaggaagaggccatgcacctggcggatctgttctttcggatgattaaagggacggtatcggacgaggaattagaagaactcgaggaggcatcggcgcttgtggacatttcacacatgccggcgcgtgtcaaatgcgcggtactcggctggcacacgcttacggagatgcttggggacgaaccggaagagaaatagaaaaatatagaaataaaaggagtggcagggatcgagtaaatctctgctgttttacaggtttttgatgccatcggttattgcagccggtatgaaccggtttataataaggaaaaaacgcagccatccggcggaggtattaaaaaccgggagcaggatggaaaatggtggataatgatgaagtttatcaataacgaaaaaatactggaaaaatacaaaaagcggtactataatgcacaataatgtaaagagcgaacaacatgttcagcaaaggatgcacgggattgtgcatagaaatggaggatacatatgttaaagtgttttgagaagatcgattggaagaagacaggaatttttgcaggcggcgtattatttggaacagccggtatcaaggtactttccagcaaggatgccaagaaggtttacacaagctgtaccgcagctttcttaagagcaaaagagtgtgtgatgaacaccgtaagcaccgtacaggagaatgccggagacatctatgcaggcgcaaaggagatcaatgaggagcgcgcagccaaggctgaggcagaggcatttgcagatgcagaggcagaagcagcagagaagaccgggactgcagagaacaccgaagaataagattttgataagaggcgagtaaagtgaagtttgcaatcaagcatgagattaaggggcggatgcggattcacgtggcacagtaccgcatgagttgtgcacaggcggatacgcttctgtattttttacaaaatgatatacaggtctcaagcgccaaggtgtatgagcgtacgggtgacgcagtcatctgttatgacggcagcagagcggaactgattgacaagctcagacatttccactatgaagatgtggaggtgccgaacgggctgatcgagaattccggaagagagctgaatgcaagctaccaggagaagctgatcggcagagtggtgagacgctatgcatccaagatttttctgccgtatcccatccgggcgtgctggacgacggtcaagtcgttccgctacatctggaagggcataaagacactggcggcacgaaagatcgaagtaccggtactcgatgcgacggcgatcggagtgtctattctgcgcggtgataccgagacggcgggatcgatcatgttcctgcttggcatcggcgagctgttagaagagtggacgcacaagaagtccgtcggcgaccttgcgcgcaccatgtctttgaatgtcggcaaagtatggctgaagaaggacggcgtggaggttcttgtcggcgcgaaggaagtccgtgagggagacgaggtggttgtccatatgggcaatgtaatcccgtttgacggcgtcgtgacagacggcgaggcgatggtcaaccaggcatccttaaccggagaatccgagccggtacgccggattagtgagaattatgtctatgcaggaactgtagtcgaggaaggggagcttaccattctcgtgaaggcggtaggcggctccagccgctacgacaaggttgtgcagatgatcgaggaatcccagaagttaaagtccgggcttgagagccgggcagagcatctggcggaccgtctggtaccgtattccctcggtggcacggcgctcacataccttctgacccggaatgtgacgaaggcgttgtcgattctgatggtggatttctcctgcgcattaaaacttgccatgccgatctccgtattgtcggcgatccgtgaggctagtttttacaatgtgacggtcaagggcggaaaatatttagaggcaatggctgaggcagatacaatcgtctttgataagaccggcacactgaccaaggcaaagccgaccgtggcaaaagtggtttcctttaacggggacagcccggatgaacttcttaggattgcagcctgcatggaggagcatttcccacattccatggcaaaagcggttgttgaggcagccagggaaaaaggtctggatcatgaggaaatgcattccaaggtggagtatgtggtggcacatggtatttccaccacgatcaacggcaggaaagccgtgattggaagctatcattttgtatttgaggatgagggagctgcccttcctgagggtacgaaggaactgttcgagagcctgccggaggagtattcccatctgtatctggccatcgagggacagcttgcagccgtgatctgtattgaagatccgctccgtgaggaggcggaggcagttatcaattccctgcgccgctccggtatcaagaagatcgtcatgatgacgggtgacagcgagcggacggcaagcgccatcgcaaagcgcgtcggtgtggacgagtattattccgaggtgcttccggaggataaagccggttttgtcgagcgtgaaaaggcagccggacgcaaggttatcatggtcggagacggcatcaacgattccccggcactctctgcggcggatgtcggcatcgcgatttcggacggtgcggagattgcgcgtgagatcgcggatatcatggtaagctcggatgatctctatcagatcgtgaccttaaagctgttgagcgacggcctgatgaagcggattcgcaagaattaccgcgtgattgtcggattcaataccggattgatcctgctaggagtcggcggcgttttacagccgaccacatcagcgcttctgcataacacctctacgctggtcatcagcttaaagagcatgcagaatcttttgagctaactgaatatgtattttgaaaagtctttacagatttgccactggcagtaaaatgcggcagaactgtgaaggcttttttatttcataggaaataccgtgatacattcatgtgtgaaagtggaactttcctatgaaagtttcagagaaaacattctgatacatttccaaaaatttacaaatttattgatgacaaaataaaaaatgtgtataataaaggcagatgtaaaaagttggcagataatagcatacagaaagagagtaccggatatgagaaaaaaatggatcagactgattgcggcagccatgggaagttttctgcttgccggctgcggtgcagatacgcagattgatgattatgctacaaatgccggagcggagagcgtgcagcagacgtcagggacggagtcggcggctgcggcagcatccgcgacggagggaattccgaaggacgagatcaaggtcggggtgcttcatctgtcagacccggcagagggaagcggatacacatacacgcatgatctgggaattcagggaatgcagcagaacctcggactttccgacgatcagattgtgcggaaaatcaatgtcccagattccgatgaggatgcgacaaagcaggcgattcaggagtgtatcgacgagggatgcaacattatctttgcgaccagctggggttacatggaggcgacagcggagatggcggagaaatatcccgatgtttatttttcccatggaaccggttatatgagcaacggcaggaatttcaataactatttcggcagaatctatcaggcgcgctacttaagcggtattgtggcgggaatgaataccacgacgaacaagatcggttatgtggctgccatggataacagcaattcagaggtgacgggaggaatcgatgcgttcgcgctcggtatctattcggtcaatccggacgcgaaggtttacgtcaaggtgacgaacagctggtatgatccggaggcggaggagaatgcggcaaagacacttctggatatggattgtgatgtgatcgcccagcactgtgatacggagtatccgcagacacttgcccaggagcgtggcgtatacagcatcgggtacaattccgacatgagcaagaatgcgccggaggcctgcctgtgcagcgttatctggaactggagtgcctactataccgcggcagtgcagagcctgattgacggaacctgggatggaagcaattattacggcggcatgaacgagaatctggtcgctcttaccaatctggcggatttctgtgcggagggcacacaggagaaggtagacgaggcgaaggaacagatcctttcgggacagaacggtgtatttgacggtgtgatcgagacaaataccggagagacggtcggtgaagcgggcaagacgctcgacgatgcgacaatcaccggcggcatcaactggtattttaagacggtgaatgttgtggattaaggagcagccggacgaaaagcgacatgcagatgcacagacgaaatggagattagtatgaacattaagaaaaagattctggggattacaattgcaccggttattatattggggttgatttccatgtttttgacaaccacaatggtacggagcgccatgctggaggagattgaggaagcacttcggggaacggcggcagccacgctcgcagcctacgatcagaatacgggagattatctccagaccagcaatggagatatctggaagggcagttataatatttcaaagtccgagagtctggtagaccgtatcaaaggcaataccggaatggacgtcacatttttctacggagatacccgcattatgacatcggcggtcgatgcaggagggaaccgcatcttaaattccaaagccggtgaccggattgtagaaaaggtactacagggcggcgaatcctatttcagccatgcggtgtcgatcgagggcactttgaactatggatattttataccggtatatcagaacggatcgaccgatgagattatcggtatgatttttgtgggaacggacaagcaggaaaaggatgccgtgatcaacaagattctgggaacaatcagcatggcggtgtgtgcggtgatgatcctatgcattgcgatcggcatgaagcttgcaacctcaatgagccgcaatatccgcagcagtattgaggtggtaggaaaagtggcggacggcgatctgaatgtctgggtagaagacaagctgctcgggagacacgacgagatcggtgatctgtcccgcgtgacgatcacgctgcgggatgccatgaaggcaactatccaggagatttcacaaaatgccaaacgcctgctcgatgcgtccgaactgctcggtacagcggcagaccagacaaacggaaccatggatcatgtgcgcatggcagtcaaccagattgtggagaattccactgaacaggcacagaattcccagaatacatcggaacatatgcgtattatgggtgagaatattaccgagacgtcggcagaggtggaactgttggatgacaatgcagcttccatgcagcagtccagtgagaaggcggcagagacgctcaacaatctgcggaacatcaatatcgaggtggaacgcattatcggtgaagtgcaggagcagacgaaccggaccaacgattcggtacagaagatccatgaggcaaccgcgtttatcacgtcgattgcggaggagacgaaccttctcagcctgaacgcttcgatcgaggcggcgagagccggagagagcggcagaggattcggtgttgtggcagaccagatcaagaagctctccgagcagtcgaatgagtcgagcaaggagattgaggagactgcgaagacactcagcgaggattctgcaaaggcggttgagattatgcagcagatgcaggagatcattatgaaccagagtgcgagcatgcaggatacgcagaaggtagtggaagaggtaatcgcgcagatcggcagctccatgcagagtatccgtcagatcaaggagagcacaggacaccttgaaagctccagaaatgaagtgctgcaggcagtgagcgaactctcagagatcgcgcagggcaatgtggacagcacaaagaagacgtacgatgagacggaagaggtagtggataccttcaagcaggtgtatgtcagtgcagagcagctccgcgagatcgcagatgagctggtcagcagtattgattactttaagatgcagtaaaacgaggggctgcccgcttatggggcagcccctttttgacttgataagtaatattataaagagaagatcatatccttcgatttcagatggaatgcatctggaaattcggatcaaaaaatgcggcatttctaccccgtcggtttttgcatccgtgatgatccatgtttttccaagttttgagcactccacgggtgtgtccgcaacccgcagacaattttaggattctcgtgtgtcccttgcggcactgctgaatagaacataaccgcgcgaagccgctgtctgagtcgtcatctgccctgttttgaatagctgatgacgacgagttcggttcgcgcggttttatattgtctgtgaagcagtgccgctagggacgctagggaatccgttcattgtctgcggtttgtcggacacattccgtggattgtcaaaacgtggaagagacacggaatccgatgcaaaaatccgacaggaagaaatgtacgcatttttttcaacgaatgttccagctacatttccatctgaaatcgaagggcatgatctgttttccattatagtacttaccacgtaaaaagggactgaccgctttatgcggcagtcccttcttttatgattcttaggcggattgttcgcagcaattatgcctgcggaccagcagatacaagtgccttaccagcatcgttgccttcgtattttgcgaagttcttaacgaatcttgcagccagatccttagcctttgtctcccaatcggaagcatttgcgtaggtatcacgcggatcaaggattccagaatcaacacccggaagctctgtcggaacctcgaagttgaagtatggaatcgtcttggtcggagcagtcttgatggcgccgtttaagatggcatcgatgataccacgggtatccttaatggagatacgcttgcctgtgccgttccatcctgtgttaacaagatatgccttagcaccgctcttctccatcttcttaacaagctcctcagcgtacttggtcggatgcagctcaaggaatgcctgtccgaagcaagcggagaaagtaggagtcggctcagtgataccgcgctctgtaccagcaagctttgctgtgaatccagacaggaagtagtactgtgtctgctccggtgtcaggatagatactggcggaagtacgccgaatgcatctgcggacaggaagataacgttctttgctgccggtgcagaagagatcgggcgaacaatgttctgaatgtgatcgatcgggtaagatacacgggtgttctcggttacgctcttgtctgcgaaatcgatcttgccgtttgcatccagagtaacgttctcaagaagtgcgttacgtttgattgcattgtagatatccggctcggaatccttgtcaaggttgataaccttagcatagcatccaccctcgaagttgaatacaccgttgtcatcccagccgtgctcgtcatcaccgatcagaagacgcttcgggtctgtggaaagtgttgtcttacctgtaccggaaagaccgaagaagatagcggtattctcgccgtttaagtctgtgtttgcagagcagtgcatggaagccatacccttgagcggaaggaagtagttcatcatggagaacatacctttcttcatctctccgccgtaccaggtattaacgataacctgctctttgcttgtgatgttgaacataacagcagtctcggaattcagacctaactctttgtagttctcaacttttgccttggaagcgttgtatacaacgaaatccggctcaaagttctcaagctcctcagcggttggcttgatgaacatgttggttacaaagtgtgcctgccaagctacctcaacgatgaaacggatagccatacgggtatctttgtttgcaccgcagaatgcatcaactacgaaaagtctcttgttggagagctctttgatagcgatgtcctttactgcattccaggcttcctgggtagccgggtggttatcattcttatactcatcggaggtccaccatacagtgtccttggagttttcatctacaacgatgaatttgtcttttggagaacgacctgtatagataccggtcataacgttcactgcacccagctcgctgacctgtcctttttcgtagcctttcagctccggtttggtctcctcttcaaataacatctcataagaaggattgtacacaacttctgtggttccggtaataccgtacttgcttaaatcgattgttgccatcttattaaacctctttcctttcatatttatatggtaaacacctgcggatagcaggctttacgatatcttttccgggatgctggaatttgccaacttcccctaccataattatacatagttaactcataaaatcaataaaaaattgttaaaattttagcaaattctgtatagaaatgggagaggaaaagagggggaacctgcggcgggaggcgttgacagtacagaagggattcggtataatccaaaagagttcaaaacaggagtttatcggcagagatatgaagttccatggaaaagagaggccgcggcagacagccgtggcttttgcactataatatagaaagaagtgggttttaattatgaggtatcagatcagacacgcacgcgtccagttcggcggggacgtgattctgcgggacgtcaattttaaggtacacgacagggaaaaaattgcggttgtggggcgcaacggctgtggaaagacgaccctgctaaagctgattgccggggatatagagatgagcaacttagacagtgacgaggagtgcggcatcacgatggcgggaggccaggagatcggtttcctgcggcaggtcaactttgtggacgcggaggtgaccgtggaggacgaattaaaaaaagtttttgtaccggtgtttgcctgtgaggagcgcatgaaagagctggaggagcagatgaagacggcggcagagacaaaggagactgcgccggatggggcgctcctgcgcgagtatgacagattgcagaagcagatggaggcgatgcggggatattcctggcgcagggatatggagacgatgttccagcggtttggatttgcactggaggatctgcggcgtccgatcggcagtttttccggagggcagcagacgaaagtggcgtttataaagctgcttctgacgcgcccggatatcatgctgctcgacgagccgacgaaccatctggatctgccgacaatcgagtggctggaaaattatctgaaaggctatgacaaagcggtcgtgatcgtgtcgcatgaccggatgtttctggacaaggtggcggatgtgacctatgagatcgagtatcacgagatgaagcgctatccgggaaactacacgtatttcatgcagcgcaagcaggaggatctcatcaagcaggagaaggattacgaggaacagcagaaagagatcaaacggctgacggactggattgaaaagtggaagaacacaccgaccaaggtggcggcgacgcgctcaaaacgcatggcgatcgagcacatggtgaagattgagaagccgagacgctttgatacgcgcgcatttcacgggcggtatacgccgcgtatcgagagctacaccaatgtgattcaggcaaaagacctctccatcggctatgatgcaccgctggcagaggtgtcctttttgctgcagaaaaaggagcgtctggcgatcatcggggagaatggcaagggaaaatctacattattaaagacactgatcggagaactgccggcacttggcggcagcttcaaattcgggcagaacgtggagtgggggtattttgaccagcagaaagcggtgatggagcaggcaccgccccagcagaccgtgcttgagaatttctgggcagcgtatccggggtacctgcgcgaggaggtgcgcagcgcgctcggcggctttttattttccggggaggatgtggagaaaaaaatggggcagctctccggtggggagaaggtgcgtctcgcactgtgcaaaatgcttcagaccagaccgaatcttctgatcatggatgagccgacgaaccatatggacatcatcggaaaagaagcgttagagcagatgctgcgcgagtacgaggggacggtgctgttcgtgtcgcacgaccgctattttatcagcaggatcaccacgggcattctggaattttccggggacgccgtgaggcagtatgcgatgaattatgaggaatacctcgcagagaagcagaagtgtgcaggcggcgtggcagcgaatgcgggaagcgccgcagggcggaacgcgggaggcaccgcagaacggaacgcgggcagcaaaggaacaggcggcgtggcagcggaagcgggaaatgccgcaggacggaacatgggaagtgccgcaggacagggagcccatgtgagaggggcggcggataccggcagtgttccgacgctctcggatgtttttgacaagaagacctattacaatccgggcaaggtgcgctcccggctgcagcgccagaaggaaaagtatgagcggatgcttgcggagagcgaggagaagctggcggagcttcagatgcagatgttagatccggcgcttgcgagtgattatccgaagctgatggaactgcagagcgctgtggatgcggaggaagccaaccaggacagtctgctggagcggatgcttgagacggagacagaactggcggagtacgaagaaacataggagatgaatgcagtgtgtctgaatacaaagacagcagggagaaacgggttacgcttctttttccatccgctttaattccggcagcactgtagacaacattgttataaagcatagacttccaccgatgacgtttgataccggttctgcggcaaagacaccgtctgttcccatgccgaaagcataaggaagaagataggtcagcggcacgacgatgaacactttgcgcagcagggagaaaaagatggcgtgctttttcttattcagggatttgaagacggtctgtccgatgtactgcagatccatgaaaataaatgcggcaaagtaaagctttaatgagggaatggcgtcagcaaccagtgcggcatccgaactgaaaatgccgatcagcgcccgcggggcaaggatgatgctgctccacatgacggcggtatagagcagaatcaggagggcgagggtcaggatcgcttttcgcacgcggtccggccgtcttgcaccgtaattgtaacttaagatcggcgaggttccctcattgatcgcgtagatcggtgtttccaccatctgccggacgcttgagatgatggtcatgacggagatgtagacatcgccgccggttgcaccgaggacattgttgcagaaaatggataccagactgttcgtgagctgcatgataaatccggcggtgccgaggcttataatgttttttgcttcgaccagactggatttccactcagccgggcgcagcagccgcaccttatattccgcgcgccggtgtagaaagcggatcacatagagcgcggacagcgtctgggagagaacggtggcaagtgcggcaccggtgattcccagatgaaagacaaaaataaaaagcggatctaagagaaaattggtcacggcaccgatggcaaccgagagcatgccggcgacggagtacccctgcgcgttgataaaggggttcataccggtggcaatcatggacggcagcgtgccgagcagatagatcatcaggtaaggataggcgtatggcagggcggcatccgaggcgccgaacagcttaagaattggcgctgcaaacagcaggccggctgccatcagcaccagagcgccggcgcacagcatggtaaatgaggtattcatgatctgaccggcttttttggtatctccgccgccgcggctgattgagaaaagcggggcgccgccgctgccgaaaagattgctgaaggcggtgatgatgacaatgattggaaaacagagtccgacggcgccgagcgctgtggtgccgacatccgggatgcgggcaatatagatccggtctacaatattgtagagcaggcttaagagctgtgcgaccagcatgggaagggcggctcctaaaatatttccggtgatggttccatgttcaaaatcgattcgtttcatatgataaacttcctttatgtatctgcgcggatttgttgttgctttacgctgcaatccagtataccatgatttagaacagatgaaaaatattgtttggatgagaactgatcagacgggaagagagtggaaacggaggatgggacggggaccggaaaagttaccgtgtacccggtgttttccggaattgaactatactacaatgacatgcacatggcgtactgcaacaaggagcagaagactgtgtatgggactgccctgttttcttactaataaaaatagaaaaacagggcagttttttgtggagggaaaggagagagagatggatgtggagataaaaaagtgaatgcgattgtggctcgcatggaagaaaggataacagacacaagtttaattgtggaaaacaggaacacctgtgatgacaattctccgacggtaccgctgacggagaagcagattgcagaattacgtgcgtgtgcagcaaagtaggttctgatgtgtccaggagtgcgttctttctttttgcgtaggagtgtgctatactcggtgacaaatgaggtttgatgagaggcttgctgcgcaaaagcgggagaggagcaacatgttatattaccgggagatcagtttaaaagatcaaagaaaatgtcttttgaaaaatgcggaacgggcggatgcagcggcgtttctgcactattttacacaggcacacgcggagacggattttctgacaacgtatgcggacgaagggacgcactcggtggaggacatggaagaacggcttgccgcgcaaaaggcgagccgcacggagattgagatctgtgcatttgtggacggcatcctcgtgggatcggcgggaaaccatgcgcttagtacgcgcgagaagctaaggcaccgcgcggatttcggcatcagtatcctgcgggaatactggggacagggaatcggcgcggcgctgaccggcgcctgcattgactgcgcgaaagaagccggattccggcagctggaacttgaggtggtcggtgacaatgagaacgcagtgagactgtataagaagtacgggtttgtggaatacggaagaaatccgcggggatttctgacccgcgacggcagatggcaggaactcgtgctgatgcggttggagctggaagatgcgggtgcgcgggaaaatgatgcggggaatggagagagcgatgttttttaaggaagatacgacgtttaatgatattcgggataaatcgctgcagcagtggctggatgagatggagcagcatgaggacgtggcggtccggggcggtgtgaagctgacaagagagtatgtgcagtatctgaaggatgagatcggaagactccggcatgagaatgaagtgaagaatgcatatctgaaaaagctgcgggagaagaggtaggaggtacagaacgtgccagagaatacaagtatcattttctttgatgaatataaaaagctggataaactttgttcggaaatgtacggtataaacagcggcggcgtaacatgttatctgaatgatatgatggctgttccggtcatgcaaagaaacaggattccagaatggaatcagacatatgacaggcttagagaactaagacatataaggaatcagatggcacacggggaaggctcgtttgaggattatccctgcagtgaagaagatgttttatggcttttcgagttcaggagtaagatcatgcatatctcggatccattggctgtatatcgaagccagacagaggaaagtatgcatgcaacccgcataaaagaagatttcccgcgggctgtagatcaaagccagacagaggaaagtatgcatgcaacccgcgcaaaagaagattttctgctggctgtagatcaaagccagacggagggaaatattgcagatcatcaaagaatgaaaatggataatgtggaagtgatcgaccaggaagaaaacgactcttttgagaaaaaacacagcatgttaaagaaaattgccgttttcggactgattgtgctgatcgttgcagctgccgtgttgatctttggcaatgtttatatgaaatattttctgctttcataattagcggagtgaggaaatgataagcaggtatcaggagaaagagggttaaaacaatgaaatatcagtcggttgccattcttggcgcaggagcagtgggttcttatgtcatgtgggggcttgcaaaaaagaaagagattgatctgtgcgtagtcgcatcgggagagcggaaggcgcgctatgagagggacggctttgtcattaacgggcaggtataccaccccgctgttaggacgccggaggaggctgccggtgtcgatcttttaatcgttgcaaccaagtatcaggcacttcgcccggcacttggcgatattcagactgtggcaggcggacacacgacagtgatgagcctgatgaacggcgtggacagcgaggagatcatcggagaggtcattgatccgtcccaaattgtctattcattgatcaaggttgcctcggagcgaaagggcaatcaggtggtattcgatccggagacgaccatcggtattgtatatggagaggcggatcttagcagaggcaccggacgcattgaggcgctgaacgatcttttcgcgggtacagggctgcactaccgtgcgacggacgtcatccgcacggagatctggagcaaattccggctcaacgtaccgaacaaccaggcacaggcgatggtggggtgcggggtaggcgcctaccgtgacagtgagcatgtggcatttttgcgggaccggctgcgggaagaggtggaccggatcgcggagaaaaaggggatcgattttgacaaggcggatacctcgtccaccttcggcagtaaggtgcgggatcgggcgcgctattccacactgcaggatctggatgcggggcgccacacggaagtggacatgttcgccggcgcggtggtgcgcatggggcgtgaactggggatcccgacaccgtacaatgagtttacctaccatatgataaaggcactggaggagaaaaacgacgggaagttcgattatgagtaggggatggggaaaataggataagaagaatgacgggaagtccgatgggaaatgatcggatttctcgttttttattttataggaaaatgcgccctatgaagtaaaaggctccgcggggatcgcactgtggcgatgacaaaggatgtcgcaagaggcaggagcaatccgccgcagggaaggaatcctaaaagaggatatgccttttgtctggtaatgggagagacgatgcaggggatattttagggcatcggtagaaagggggagattcttgggactttttgcaggatgccgacggaatatgataattttcgacaaatgcggtatgacaaagttttttattattaggaaagagaaggtggcgtatatggataaaatggataaggcgatggagggcgttttggaatatttgaaacataagggaaaacttacggaactggagaatgatattcttcttgcaacgcaaatctgtcaatcaagcccattcgatagcgaggcggctaagaaaagaataatggagtttaatgcaaaatatagggaagtatgcagttctattcttgtaactccgggaatcaaaacaaaaccattgtttgacatgaaagatgaggaagtctgggaaagcctctggatacaagtggaagcattgtgtggaagggaactgggggagattgagaggagaaggatgagcagaaaattgaagatgatatgatgcattatacttgtaaatagaacgacgattgaggtagaatggaagagaagaggaaaagagttataaaagatcgattataaattatgaagaaaattttcgtattggtggaaaaatgtaagcattaaaatatgcaagcatagaacttgatgtgtgatttggtaatagggtcaatggatgaaatagtggaaagggatgtgagtttatggaaaatgtggaaattaatattactcctatgtctttgaaaaatggtgttatgggtttgcctatacaatgttgtagaaattgggatgcatcagggagtgttgaaggtatttttcagtatgcgggacgtaaatcttctataacattttcgcctaagcataaaaataaagaaagaggaacagctgcagcgtggcaatttactgttaatgattcgattcagtttaatcagttaaggatggatggaattcatacatatgttgaggagatttctattggagaaaagctgatatgctcattatgcgaaagtggtggtttgtatttccttacagttgaaaatgtgatcaatagaccggaaactaaggcaacacaaaaactgaaagctttattgaaacaaggatttcgggaagaaaccggaaaaatgtcaaaagcgccagtgtggaatagtccaagtgaatggatttcatttgataaaatcagcaattattctgaagtgcaagattgtctttatatttggacaggaaagaagacaggatataatacggtatatttatatgtcggaattgtgggtgatacaaaaagcgaaggccgtagtaagcgaaatttgatgcaaaggctgaaagaagaacagaagaagttctatacggaatgtggtgttaatattgagcaatttagatattgttcgcttaataatgcctttgattattctgtaccagaattactaaaaacggttgaaatgtcacaaataacggttatgacctctttgtttcaatgtaaaaatgcaagagataatatagacgcattgctggcggggtatgatgtaattcttttgaataaaatgacatcatataaatatattaagtaaaaattgcagatatgaaatttgataattatgaaatcttctcattatggttccgttcataccgcccggagggcgttacgactagctttttggatgataattgatgatgatatttcgttaaagaatccatttggatgtcagtttgctggagtattggttaatgatgtagtcataagagaggcaatctccaaagactaaatgagaaaatttctaaatatctgaattttacaaattgacacagaaaggcgttgatcttgaaaagcaaaacatgaatatcgactactagttgtagaaaatatagtatatgcgatatgctgataaactatagtgatataatggtgttgtagtttgatacggatgtggcacaactgtttcaaacaatcatcatgaataggaacgcgactaaagtggagaaatctatagacggatatagtggatttcctttctgtgataatgtaatgccaattgtggccctgtactgatagcaccgattcaacagacagcaataatatttatgaaatgtctaagagtactgttatttattgaaagtagaaaagaatttcagtggaataagaatagcagagaagggatttaatgaactttaatgaagaacataagctttgaagaatgagtggagatttgtatggtatttgttccacgtatggaatataatgtatgtaggagggggtaatatgaataagacatattcaatgagtatacgtgttagtgaggaagaacttgaaaagcttaaacaagctgctcggttagaaacctacgcttcgtatagcgagtttgttagaagaactgccttgctagaggcatcaaagattattactgagaatactgagaaggagaataagaacaatggctaaaaaagattctagcgaggaaacaaccaaaggtttggttgcagataaactgaaagaaattgatggctatcctatggcgcaaaatacaacagtggatgggataacttggttcaaagaagatagctataagggaacgtcttatgattggctgaaagatgtatttaaaaaagcatcaaagaagcagactatgcgttcaaagggaacgccagattatgttgtaacacttgatggttcagacatcattatagttattgaatgtaagggctctgtagatgatcattcatgtctagatgacgttgaagattatgttaaacatgggtatggtggggcagatgaaactgaaaagtatgcaataaacggagcgttatggtatgcatcttttttgaaatccgattatgatgttatatctattggcatttcaggtcaaacggagcaaacagcaagagtttcgtcttttgtttggcctaaaggtgaggagatttcgagtattgcacttattgaagatggttatttggataattcgctagtatctattacccagtataagtctgatgttaacagtgttcttggaagaatgggagaaacagaggaaactgttagaaagcagttaagaaggtatacgcttaattgtgctaacttcttaaggcagaatggcattgaagataattcaaaagcaggatttgtgtcagcaatcattcttggcttaactaatcatgaatctgcattatataaaaacacaaaaaatgcaattgaccataagaagagtactaaagcgaagaaaatgctttctgatccgattggaaaaagtgctgttaatcagcttaaaagctcattgtatggcgatggcaaagatatatatgatgaatcatatataagaggaatttgggatatagatggaattccgcagggaaaaagaatatctctaaaaaagttttatgatacgcttcttgcaaaggatgagttgacacaggcaccaaagggaaaagataaattatttccagacggagatactgtcttgtcatgctgcatatattctttgtatgaaaacgtaattgaagtactagatacttatactggtattgatgtaatgggtgaattttatactactttcttaagatttacaaaaggcaatgcaaaggaaaagggaattgtattaacgcccaagcatgtgacagaacttttttgcgatattgcggagttttatagtgacagaaaatttgatgagaatacaaagatattagatatttgttgtggaacaggagcatttttgattgcttctcttaacaggataaaacaaaatattcaaagtgaagtagttagcgatgaaaagaaggtatctagatatgaggatgcacagaagaacagcttaataggagttgaacgtgatgcatctatgtatgcacttgcttatgctaacatgagatttcacggggatggcaaatcaaatttatttaactgttcttcactgttgatagattcttacgctccggtagatgatagcggaaagacatatacagatacaggtaaaattcctttaaatgaagcgttaagtgattttggtgatatagatattggtatgattaatccaccatattcacttgataaaaaggataattcttccaagcaagaatatcctatagttaagcagataaatgagctaaaagataagaataaaaggcttaataaaaaaatcaaggaatatcgaaaaaagacagacggaaaagattattcagaagctatttttaattgccaaaatgagataaaagccaataatgatttattaaataagtatgaaaaagattttacaaatagtggattaagagaagttgcaattcaaaaggggcaagatgagttagatttcattgcttccatgcttcattatttgaaaaagggaggtattggtttggctattgttcctatgtcttgtgcgggaaatagtggtactaaattaagagcagagttattgaagtatcatacattacttgcatgtatgacaatgccaccgcaattattctatgatagccatgtaggaacagctacttgcattatggtatttaaagcgcacattccacatgataaaaacaaagcaacatttttcggaagatggcaaaatgatggattcaaggttattccacacaacggaagaaaagacaccggtgcatggagtagtatacgagaagaatggataaaccaacttgatggtaccgcagccattgatgatacaatttggcttcgtaaaaagattaacccgaatgatgaagcgttggcagaagcatatattgaaactgattataataagttggatgattcggtatttgaaaggacaatcaagaaatatgcattgtataagtacatggatgaaaagggtttgttgggggattaagtatgaaacggctcgatgaaatattcactgttacatatggtgttaatctggaattatgctatcttactattgatgattcagaagatgcgataaactatgtgtcgcgaacaaagagtaaaaatggtgtatccgctcgtgtttcacgaatggagaatgtgaaacctaatccaggcaaaacaatttctgtagctttgacgggtagtgtgttagaagcgttttatcaggaagaagaatactattctggaagagatatagcatatctaacacctattaaagatatggatatgtggactatgattcagtattgtaccattattcgatataatcaatataagtattcatatggacgtggtgcaaacagaacaattggaaaattatttattccagatcttgatgaaataaaaactttcccgaagtataatcaacttccggatatatcacagataccagattactttttgaacgagggatataataaagcgtgttggtatttagataacattgataaagatgagtttgaaaagaaatatgctaaacctgcaattaataaaagaatatcactaaatgacagaaaatgggattatttcaagttaaacaaattgtttgatataaagaaagggaaacgattaacaaaagctgatcaaacaatgggagatactccctttataggtgctacagcaattaataatggggtaactggttatataggtcaagaaccaatgcatgaaggtaatactatttcattgacgtataacggttcgattggtgaagctttttatcaagaagtacctttttgggcgtctgatgatgtaaatgttttatatttaaaaggtagggaattaaatcctcatttagcattatttttttgtcaaattcttagattggaaggcgaattacattcttacgccagaaaatggaatttggaacatatgaatgatacaaagattaagcttccgattgataaagatggggagccagattatgactttatggagcaatatataaagtcattatcttttagtggaaatatcggataatcaaataataatatagttaaggagcattttagagtttgaaaaaagtctaaggtgcttttttatccacaaaaaaacgaagggagtaagacaaagatttaaaacacagaaaatcaaagtaactattaaaaactgagtaggcattagctagggcaaaggaaaagcttagcaaatgtgaaccatcagtttgaaacagcgaaagcggaggtaaataagtcattcccacaaggggcggagttatccggaaaaatggagagtctgacagaatgaatgctttacttagcattaatgaaaagtaggagtatgattggaatggatgacgaagcagaactggaaagaaaacttgtagattgatcatcagaacggattccatagaaggggaaagataatgatttctgaggatgctgagtttgattattgttttactgtttaggtgggaggcgttaatcaatcaacgagaatttgaaaaatttcctaatcatacgacagctttgtggctagtaaaaacataaaacttttaaaatggtgaaatcttccttggtatggtataatatatttattgcgctagggctgctttgaagaaagggaaaaaggcatttgagcgaaagaaggcgtaagcagaacagacgtgataaaaagaggggtattttatgaaatagagaaagccagcgagtagatggtagatacgcatttatcagacagttttggaaaacagaagatttttaaagtcatattgtagaaaaccgaaaagctaaagaagggaccggcgatagatggatataagggattttggtatttagacaagaagaatatcccggaagttgctttacattgggaaaagtactttgagcggacaagggctaaacataatggaattttaaaagaatagttactaaaaccacaccacatgtttgtggcatacttgttgcagtaatagcgggataaaccataaaacactttagtattttattggacattctgccattggagtaataatgaatacatatatgcatctgggagcagaagatgctaagaaagaatttggcaaatatacgaagatggcttaaataattagaaaattgcgacaaaaaagataacctaagtgaaaaaagtctttagtaaaatgagaagatcgatctgttttactaagatttttactaaatctggataacagaatatgcggatttatgtcacgatatgcgacgaaagtaaagaaaataatctatcgtaaaagtgaaataaaatcagtattttcaaggagtttttaaggcatgataaaaatattatttatttgccacggcaacatctgccgttccccaatggcagagttcattttaaaagacaaagtcgaaaagcgaggtctcacttcccgtttcgagatcgcttccgctgccacctccacagaagagatctggaacggaaaaggcaatccgatctatccgccggcgcaggcagaattgagacggcgtgggattgacgggacggcgtacacggattttagcggcaagcgcgccaggcaggtgaccagggaagactatgagcattatgactatttactctgtgcagatactgcgaatatccgcaatacgatccggatcacgggagcggatacggaggggaagatcaggctgttgttagattacacggacagaccgggctgctcaatcgcagacccttggtacagcggtaattttgaggatacctaccgggacgtggatgccggatgcgagggatttctcgcgtacttaaaagaaaaaggtgcaatttagagaagatgtcagtaatgcaccgtgccgcacatattttacaaaatatttgaaaaaatatcttgaaaaccccagaatgatgtggtataaatgttacaacattaaattgttaaagcatgaaaggctatgaaggagactcttatcttcagacatcgacaggaatacagcgtcaccgactgagagcgctgtttgagagagaagataacgggaacactctggagcagactggttgaacaggcggttatcctgcgggtagaagtaagagtgggacggcagcggtaaagtaggtcagtacgttggtgcgcgttaagcacaaagagtggaagaatgatttttgtgaatcatttttcaaagcgggtggtaccgcgggaatacaagcagaagttgcagaagaagatcccgccccggaaagacagtttgtctttccggggcttttttgttctatttaggaaatattgcatcaggttaaatgagaaagcagccgatgcacgaaaggaatcccgtcccgcacctagatcaatccggcagcaccggacgaaaaggagcgtacaatatggaatatgtaacaggagtgagcaaaaaagaaacggtggaaatcagtgaaatcctttccggggatttcgagggaaaacaggtaaaagtgaatggcgccgtccacaccatccgcgatatgggcgaggttgcatttgtgatcctgcgcaagagagagggattactgcagtgcgtatttgaagagggaaaaacaaagttcgatttaaaagaactgaaggaagcgtcgaccatcgaggtggagggaaccgtgcgggcagagcaccgcgcgccgaacggatttgaggtacgtctggatacaatccgcgtgttgtcggaaccggcggaacagcttccgtttgcgatttccaagtggaaactgcaaacgacgttggagacgaatctggatcaccgtgcgattgcgttgcgcaacgtcagagagcgggcgaagttccgcatccaggagggcgtggtcagaggattccgtgattttctgtacagcgaagggtttacggagattcatacaccgaagatcggagcgaaaagcgccgagggcggcgcgaatctgttccggctggagtattttcacagaccggcagtgctgcagcagagcccgcagttttacaagcagatgatggtgggcgtgttcgaccgggtatttgagaccgcgccggtgttccgtgcggaaaagcacaataccaagcgtcatttgaacgaatataccagccttgactttgagatgggatacatcgacggatttgaggacatcatggcgatggaaaccggatttttacaatataccatgaagtttttggagcgggattacgccaaggaattaaagatgcttggcgtgacgcttccgaatgtggagcagatcccagcggttcgctttgatgaggcgaaacagaaagtggcggaaaaatatcaccgccagatcagaaatccttacgatcttgagccggaagaggaagcgctgatcggacagtattataaggaagaatgtggtgcggattttgtatttgtgacacattacccgtcgaaaaaacgtccgttttatgcgatggacgatcccgcagatccgacatacacgctgagctttgacctgttgtatcacggactggagatcacgacaggtggtcagagaatccacgattatcagatgttgctggataagatcgagaagcgcggcatgacgaccgagggaatggaacagtatctggcggtattcaaatacggcatgccaccgcacggcggactgggaatcggacttgagcgcctgaccatgaagctggtcggcgaggacaatgtccgcgagacaaccctgttcccaagggatttaagccgcctggaaccgtaaacaagacccaagagaacaaagcggcttaaatcgcttttggatctaagccggttagaaccgtagaaaaataaaaagcaacaaagcggcttaaatcccttttagattctaagccgcctggaactgtagaaaaatgcaaagagaacaaaacggcttaaaataacaacagaaaaggaactcacacatgaacatagaacaacagattgcagactacaagccgtacaatgagcaggaagcacacgatcaggcagtgatgcggcagcttcttgccacacagccggatttatttacaagagagaatcaggtggcgcatatgacagcgtcatcgtggctgttgaacgccacgcacgataaggtgctgatgatctatcataacatttatcactcgtgggcgtggacgggcggtcatgcggacggagacagagaccttctggcggttgcgaagcgcgaggcgatggaggagaccggcgtgacagagatacgggcgatttcggaagacatcttttcacttgagattctgacggtcgacgggcatgagaagcgtggagcctacgtgccgtcgcatctgcatctgaatgtgtcgtatcttctggaggcggatgaagccgaagtgcttcgcatcaagccggacgagaacagcggtgtgcggtggtttttcctggaggaggcgctcgcggcgtgcagtgaaccgtggatgattgagagagtatacaaaaagctgaatgcaaaagtgcgggagcgtttcggcgggacgtacgggatgcagagaggagaatgacagtgaaagatttgggaacaaaacggcttgagacagagcggctgattttgagacgttttacattagaagatgcagaaaaaatgtatgagaactgggcgggcgatcctgaggtcacaaagtttctgacctggccgacacacgagagcgcagagatcagcagacagatattaaaagagtgggtagcggcctatgacaatccggaggtataccagtggtgtatcgaggaaaaggagagcggagagccggtcggcagtatcgctgtcgtgagccgcaatgaaaaggcacagtcctgcgagatcggttattgcatcagcaggagccgctggcacaaaggcattaccacggaggcacttgccgaggtcatgcgctatctgtttgaggaggtcggcgtactgcggctggagtccagacatgatccgaagaatccatattccggagaggtcatgaaaaaatgcggcatgcactacgagggtactagaattcgtgcagactggaacaataccggtatctgtgactgcgcattgtacggcatggtgacatacgtgggtgtcgggaatgcggcacagacgacagatagcgtgcagttgaatggaactgcaggatgggcagcggacggtgcagaggcgaaaggggagaagcagggagcgcagacagagcgcacaccgaagaacgtgatttccgatgagacgatcgagtacgtcggaatccttgcgaagctggagcttgacgacgaggaaaaagagcgggcgaagaaagatatgggggagatgctcgattacattgacaaactcaatgaactggacacggagggcgtggaaccgatgtcgcatgtattcccggtgaataatgtattccgggaggatgtggtgacaaatggcgacggaagtgcagacacacttgcgaacgctccggtgaaaaaagacggcggctttaaggttccgaagacgatctcataaggcagggcatgagagagcgtgcatgcgcatgaaagagggaaagtgaggaaaacagatgagtttgatgagtttgactgccgtggaactcggcagaaagataaaagaaaaagaagtgaccgtcgaggaggcagtgacggcggctttagatgcgattgagaagcgtgaggcacaggtgcacagctttgtgacggtcgacagagagggcgcattaaagcgtgccaaggaagtgcaggcgaagattaatgcgggagaactgaccggaccgcttgcgggtgtgccggtagcgatcaaggacaacatgtgcacgaagggattgcttacgacctgttcttccaaaattttatacaatttcgtcccgacctacacagcggaggcggtccttaatctggaaaaggcaggagcggtcatcctcggcaagacgaacatggatgagtttgctatgggaagcacgaccgagacctcggcgtacggcgtgacaaaaaatccgtggaacaccgggcatgtgccgggtggttcgtcgggcggttcctgcgcggcggttgcagcggaagagtgcagctatgcgctcggttccgacaccggtggctcgatccgtcagccgagctccttctgcggcgtgaccggcatcaagccgacttacggaacggtatcccggtacggactgattgcctacggttcctccctggatcagatcggaccgatcgccaaggatgtgaccgactgcgcgacgatcttagaggcgatcgcatcacatgacgtcaaagattccacatcggtgcagcgcgaggactatgattttacaacggcgcttgtggatgatgtgcgtgggatgaagatcggtatcccgagagactatttcggcgacggactggacccggaggtaaaggcggcggttcttggcgcggcaaagaagctggaggagaaaggtgcgatcgtggaggagtttgatttaagtctggtcgagtatgcaatcccggcttactatgtcatcgcctgcgcggaggcgagctccaacctggcacgttttgacggtgtcaaatacggttatcgcacagagcagtatgacgggcttcacaatatgtacaaaaagacccgctccgaaggattcggcgcggaagcgaagcgacgtatcatgctgggatctttcgtgctgagcagcggttactatgatgcctactatttaaaggcactccgcacgaaggcgctgatcaagcaggcgtttgacaaggcatttgaaaaatatgacgtgatcttaggaccggcggcaccgacgacggcaccgaagcttggcgagtccttgagcgatccgctgaaaatgtatctgggcgacatctatacgatttccgtgaaccttgcgggactcccgggaattacgcttccctgcggaacggatcagagcggactcccgatcggtttgcagctcatcggtgattgctttgcggagaaaaaaatcatccgcgcggcatacgcttatgagcagaccagaagctacgaacacagtccgttggcacgatgacagtgggaggatgagatagatgagcaaaacatacgaaaccgtaatcggactggaagtccatgtagaattagcgacaaagacaaaaattttctgcggctgctcgacagcctttggcggagcgcccaacagccacacctgcccggtgtgcaccggtatgccgggatcccttccggtattgaacaagcaggtggtggaatatgcgatggcggtcggacttgcgacgaactgcacaatcacccagtattgcaaatttgaccgcaagaactatttttacccggataacccgcagaactatcagatttcccaactgtatctgccgatctgccgcagcggcggcgtggagatcgagacggctgccggcaaaaagacgatcggtatccacgagatccatatggaggaagatgcgggaaaactggtgcatgacgagtgggaggacgtgtccatcgtggattacaaccgttccggcgttccgctgatcgagatcgtgtcggaaccggatatgcgctccgcggaggaggtcattgcctatctggaaaaattgaggctgatcatccagtatctcggtgcatcggactgcaaattaaacgaaggttccatgcgtgccgacgtcaacctgtccgtcagggaggcgggagccgctgagtttggaacacgtaccgagatgaaaaacctgaactctttcaaggcgatcgcgagagccatcgaaggcgagcgcgcccgccagatcgaattgatcgaggaggggaaaaaggtcatccaggagacccgccgctgggatgacaacaaggaatcctcccacgcgatgcgatccaaggaggacgcacaggactaccgttatttcccggagccggatctggttccggtggtcatcagcgacgagtggattgagcgcgtgaaggcacgccagccggagatgcgggatgagaagctgatccgctatcaggatgagttcggtctgccaaaatacgatgcggagatcctgaccggagacaaatcatttgcagatctgtttgaggcagcggccgcgatctgcggaaagccgaaaaaagtctccaactggatcatgacggagacaatccgcctgttaaaagaaaatgaaatggatccggatcagatccgcttttcaccggaacatcttgcaaagctggtggatcttgcggatgccggttccgtcaccaacaccgtggcaaaggaagtcttcgagaaagtctttaaagaggacattgatccggaagcctatgtgaaggaaaaggggcttttgacagtcaatgacgagggagcactccgtgagacggtggcgaaagtcattgcggagaatccgcagtcggtggaggattaccacaatggaaaagaaaaagcgatcggctttctggtcggacagacgatgaaagcgatgaagggaaaggcaaatcctgcactggtgaaccagatcttaaaagaattgctgtaagcggtcagtgtcttttgtagtgataagcagtattacaggaagaactgagaacagaaagttccggaataaccatacggcggcaaattttttgaagcaaaattcaagtatttcttccatgccgcggctggtatttcattccgtgtctcttccacgtttggactctcccggagggtgtccgacaaatcagagacaatgagcggactttctagcggcgctaatgcgcgctccctcataaacattataaaatcgcgcggactgaaactcggagacttctgctattaaaaacatggcagaaatctcctcagacatcagtccgcgcgattaggttttactcggaagcgtgcaaagcgccgcacgaaagctcctaaaattgtctcatgatttgcggacaccgtccgaggagtgctccaaacttggaaagacacggatcatcatgaatgccagccttcgcttggttagaaataccggattttgcggtcaaaatttgccgccgtatggttatctggaactttcaggtatctgtttctaataatactgcttatcccttaaaaaggcacagtcggtttatctgcggttgggattccggtatttttcttcgcagtatttgcagcggtagacttccttttcttcatcggtcaggaggaagatctggtcaagctcctgctcgatggaagtgatacagcgcggattcctgcaggtgatgacgttcttgacctgctttggaaggtgcagttcctttttctcatagatcttgtcgtccttgatgacgttgactgtgatattgtgatcgatgaagccgaggatgtcgagatccaacgcttcgaccgggcattccaccttcaagatatccttcttgcccattttgctgctcttcgcgtttttgatgatggcaaccgtgcagtcgagctcgtcgagcttcaggtcgtggtagatctgcaggctcataccggctttgatatggtctaatacaaaaccctcgtggattccactgatatttaacatgtatctgtcctttctgccgattttatttaatcgaccctgatgtctaagagtgttaggatcagcgccatgcggacatagacgccgtactgtgcctgcttgaagtaggcggctctcgggtcgtcgtcgacctcgacggagatctcgttgactctcggaagcggatgaagcaccagcatatcctccttggcgagatccatcttcgctttggtcagaatgtagaaattctttaagcggacgtagtcttcctcgttgaagaagcgttccttctgtacacgggtcatgtataaaacatccagatccggcatggcgtcttccagacgctccacttcggtaaatgggatattgttcgctgcaaggacgtcctcgcggatgtagcttggaattctaagttcttccggggagatcagcacgaaacggatgcccggatagcggatcagcgcagagattaaagaatgtacggtgcgtccgaattttaagtcgccgcagagtccgatcgtgagattgccaaggcgtccttttaaagaacggatggttaacagatcggtaagagtctgggtgggatgctgatgaccgccgtcgccggcattgataacgggaattcgggatttctgggaggcaacaagaggtgcaccttcctttggatgacgcatagcacagatatctgcatagcaggaaataatacgaatggtatcggaaacgctttcacctttggctgccgagctggaatcggcactggcgaaacctaaaacagaaccgccgagatttaacatggcagcttcaaaacttaatctggtacgggtgcttggctcataaaaacaggttgccagctttttcccttcgcatgcatgggcatacttctgtgggtacttctcgatatcgttggcaagatccaaaagcttgtccaactcatcgacggagaagtccaatgggctcattaaatgacgcataaaatcctccttgtattgaccggaaacggcagaacaaatctgtctgtctccaggcattttttctatcatataataatcattctgtgaattcaaggggaaaaatatttacgcacgaatcgggaaaagacgggctgtttggcatgatatttcaaaagatggaagccgttttctgatatttggttgcgcgaaaaagaaaaatgaagtaaactacaggtacgcagaaaagaatgcaaaaagtttcgcctggggaggaacatacaaggaaaggaagaacagacatggcagaagagacaaattttagtcagggagaagcggaggaggtaaagtatcaggagcgtaaacggttacttttcttcggacttccatggacatttaccaaatatacgatcagtcaggatatgattaccgtcgatgagggattgatcaaggtggaagagaatgactgctacatgtacaaagtgcaggatgtcaagctgacagccacactgccggagcggattttcgggctgggaacgatcatctgctacaccggagacgtgacagacaaggaacttcgcctgagtcatatcaagcatgcaaaggagattaagaattatcttctgaaggcatccgaggcggcgcgcatcaagagacgcacattaaacatgcaggacatcggtgcaggcattgcagatgatgtggatctgtaggaagtgtgcggcatcgccgcgcgctgacgggttaagtgagacggtcggtgtgcacgaggatgcgctcgaagagcagacctgcgccaagccacaacggggcataatccagccggatcagcccgttgacgtttgccctggcgctgctgtagtcccaggggcagaagtgatgccgccttaagagtgatccggttaagtactcgaatgaaaaaatacccactgtatagatgctgccgcgcaggagtgccggcagcttttttatttttgcgtagaccggaccgatgcaggcagccataccgtagatggggaacatccacagggaggtctgaccgatcagacggccgtcgtgtcttgcgagggagcctgcggaggtgaacagaatttccatgcaccagccggtcagtccgcagatgagaaaattacgtccgcgcatatgagagattcctccggttttcgtttatttcagtatttccggttcctgacaaaatatgtacattttctgaaattaaaatgaaataaatcgggataacttgtaaaaccttaagatctggcatataataaaaaaagcgaattcggcagaggatgacatgcggctgaatcaattattgaaacatcttacatatgaacatgtgcagggaagccagagccgtgagataacagacatctgttaccattccgggaatgtcagggagggctccctatttgtttgcctaaaagggctgcatgccgacgggcatgactatctgcagggagcgctggaagccggggcggcagcagttgtgattgcggcggagaatgtggttccgctggacaatgatgcgcttttgtacacggaacagtttggtgtgcggatctcggagattatagaccgatggaaggtttccatcgtgatcgcggcggataccaggcatgcgctcgcagaacttgcggcagctttttttgattatccggcggcaaagcttcggatggtcggaatcacgggaacgaaagggaagacaacgacggcatatctgctttctgcgattcttcgtgagagcggacacaagaccggaatgatcggaacgatcgcgatcgataccggagatggcgtgcttccggcagtacatacgacgccggaagcctacgagatacagaagtatcttgcacagatggtggacaacggctgtgatacctgcgtgatggaggtctcctcccaggggttgaagatgcagcgggtggaggggatattttttgacatcggcatgttcttaaacatcgagccggatcacatcggggagggcgaacatgcgtcgtttgcggaatatctgttctgcaagagccgcctgatgcgccagtgccggatcgggattgtcaatcgggatgatccgcacacggagcgtatactgcagggacatacctgcagcgtggagacgttttccctgtggcatccggcggatgtgacggcggagaatatccgctttttcatgcagtcgggagaacttttgggaagctttctggtgcgtgtggagacggcggtgtatccggtgagaatgcagctccccggaatgtttaacgtctacaatgcgctggcggccataggggcggcaggacatctgggagccacggagagcgacgtcggtcttgcgctccgcagtgcaaaagtccccggaagatgcgagaacgtgaggcagtccgaaaattatgccattctgattgactatgcacacaatgagatgagcttaaaaaatcttctggaaatgctgcgcggttttaagccgcggcgtcttatcgtactgttcgggtgcggcggcaaccggtcgaagctcaggcggtcgaagatgggagagacggcgggacatctggcggatcttacgatactgacttccgacaacccgcgctgggaagacccggaggagattctggacgacattgaggacgggatccggggaactggcggacagtatgtgcgcattgcggaccggagggaagccgtgcggtatgccatggcgcaagccatggagaatgacatgcttgtgcttgcgggaaaagggcacgaggcatatcaggagattcgcggcgtgcgctatccgctcagtgaatacgagctggtggaggaagcgagacgaagccctgacatgggggagaatacagacagaaacgaggtggacagatggcggaatatgcgaaggtgattgtggatatttcacaggaaaaactggataagacatttgagtaccgtattccgccgtatctcacacagcggatcacagtcggaatgcaggtctatattccgtttggcagccgcaggatcaccggctatgtggtcgagctttccgatgaggcggagtatgacgaggataagctgaaaaatattgcggggatcgtgacggacagtgtgccgatcgagtcccatctgatcgcgcttgcgggctggatgcgggaacattacggcggcacgatgaaccaggcgctaaagatggtacttccgatcaaggagaagaaaaaagctgtggaacataaaagggtgcggcttgcgcttcatccggtagaagcgaagaaccagctgggagcgtatgagagacgccacagcaccgcccgcgccaggctgcttcgtgcgctgctggaagaggaggagctggactgggatcttgtcacacacaagcttggggtgtcgggaagcgtgatccgggcgatggaggaatccggcgtcgtcaaagtaattcgggaaacgcagtaccgcaatccggtgtcccacctgaccagcagaggatatgggctcactttaaacgatgagcagcaggaagcggtggatgcggtctggtcggattacgagaagggaatccggtcgacctatctgataaaaggcgtgacgggcagcggcaagaccgaagtctatatggaactgatcgcaaagatgcagaaggcggggcggcaggccatcgtcctgattccggagatcgcactgacctatcagacggtgctgcggttctataaccggtttggcgaccgggtatccatactgaattccagaatgtcaccgggggagcgctacgatcagttccttagggcaaaaaacggggagatcgacgtgatgatcggtccgaggtcagcactgtttacgccgtttgccaatctggggcttatcatcattgacgaggagcatgagacttcctataagagtgagacggttccgcgctaccatgcgagggagaccgccatcgcgcgggctgccatgcttgacgcgagcgttgtgctgggatcggcaacgccgtcggtggacagctattaccgggcgaagcgcggggaataccggctgcttacgctcacaaagcgcgtgaaggaaagaccgcttccggcatgcggggtggtggatctgcggcaggaattaagagagggcaaccgctccatcctaagccgcaggttagacgggctgatggagcagcgcctgcgggcgggagaacagaccatgctctttatcaaccgcaggggcgtggcgggctttgtctcttgcagagcctgcggacatgtgataaaatgtccgcattgcgatgtatcgctgagccagcatgcgaacgggcggatggtctgccattactgcgggtatacggagccggtgccggtacaatgtccggcgtgcggatcgaagtacatcagcgggtttaaggctggaactgagaagatcgagatggttgtcagaaaacgatttccggaagcgcgcgtgctgcgcatggatatggataccacgcggggcaaggaagactacgagcagattttatcggcatttgccaatcacgaggcggatatcctgatcggtacgcagatgatcgtaaaggggcatgatttcccggatgtgacgctggttggcgttcttgcagcagatctctcgctgcatgtcggggactatcgcgcggcggagcggacattccagcttctgacacaggcggcaggaagagccggccgcgggaataagccgggcgaggtcgtcatccagacttatgacccggagcattacagcatagagacggcgaaggcgcaggactacgatgcgttttacgagcaggagattgcgtaccgcaagatcatgctttacccgccggtctggaacatgcttgtgatcttgtgcgcctctaagagcgaggaggcggcggatgccatggcggcagagcttgcggcggcagcggatgcgtatacagggaagaatacgaaagagaaggtctatctcgtgggacccgtcgacgcggcgatcgcaaaagtgaatgatatttataaaaaaataatttatctcaaggcagaaaattatgacacgctggtaaagataaaaaataggacagaagtgtatgccagagagagccggtactataagaatgtgaccgtgatgtttgatttcaatccggtgaacggcttttaggcagaatggaggaaagatggcacttaggacaatcagaatacagggagatcctgtattgaccaaaaaatgcagagagattacagagattacaccgaagatcagagaactggcagaggatatgcttgatacgatgtacgaggcgaacggcgtgggacttgcaggtccgcaggtcggcgtgttaaagcgcatcgtcgtcatcgacatcggcgaaggaccggttgtgatgatcaacccggtgatcttagagacttccggcgagcagaccggcgacgagggctgtctgagccttccgggcaaggcaggcaccgtgaccagaccgaactacgtgaaagcgcgggcgtttgatctggatatggaagagtatgagattgaggggacagagctgatggcgcgtgccatctgtcatgagctggatcatctggacggacacatgtacactgagaaggtggaaggtccgcttcacgaagtcacctatgagagtgatgaggaagaataaagcatggatgatctgtgaaaatggaggtcagtgatgagagtcatattcatgggaacaccggatttcgcggtgggaacgttggaagaaatcataaaagcgggacatgaggtggtgctggttgtctcccagccggataaggcagtgggaagaagcaaggcgctccgctatacaccggtcaaggcatgtgcgttcgagcacggcattgaagtatatcagccgcagaaagtcagagacagcgagtgtatcgagcgtctgcggacatatcatccggatatcataattgtggaggcttttgggcagattataccgagagcgattctggatatgccgcgctacgggtgtgtgaatgtgcacgcgtcgctgcttccgaagtaccgcggtgccgcaccgattcagtgggcggtcataaacggcgacgccgtcaccggagtgacgacgatgcgcatggacgagggacttgatactggagatatgatcttaaaggaagaagtgaagatccgtgcggatgagacgggcggcagtctgttcgaccggctgtccgaggtcggcgcgaagctgtgcgtgcgcacgatggaggcgatcgatgcgggaacggcaacctacacgccgcaggataactcccaggcaacgcataccgtcaagatttacaaagaaatgggaagcattgactggaaacagggcgcaaaagagattgagtgcctgatccgcggactggatccgtggccgagtgcctataccagactgggcgataagatgttaaagatctggaaggcgcaggtcgtttctgaggagtccggggcggagccgggctgcattgtgaaagtggaaaaagatcatattctggtgcagaccggaaagggaatgcttgccatcagtgaacttcagcttgagggcaagaagcgtatgccggtggaggcatttctgaacggatatgagatcgaagagggcacatattttaagaaagggtgattactatgccatattcatactattactggggatttgatccgacgtatatactcgtgctcatcggagcagtcatctgtctggttgcatctgcgagggtgaagtcgacatacaacaaatatgcttcctaccgcagcatgtccggcatgaccggagcacaggcggcggaacggattctgcactcggcaggaatctacgacgtgtcggtgcagcatgtatcgggcaatctgaccgatcactacaatccgtcgaacaagacgctgaatctgtcggattctgtgtatggaagcacgtcggtggcggctgtcggtgtggcggcgcatgagtgtggacatgccattcagcaccagcagggatatgtgccgcttgcgctgcgctcggcgatcgtgccggtggcaaatctcggttctacgctggcgtggcctttaattttaatcggattattttttaccagcaatacagggacatttttgatcgaccttggaattctttgtttttcgttcgctgttctgtttcagcttgtgacgcttccggtggagttcaatgcatcgcaccgcgcgctgcgcattttaggagagcagggaatcttaagcgacagtgagctgccttatacgcgaaaagtgttgaaggcggcggcacttacttacgtggcgagtgcggcggcatcgattctgcagctgcttcgtctggtgttattatttggaggaagaagacgtgacgactgattccgtgaatacgcgggaactgattcttgagatccttttagaagtgacggagaggggacagtacagccatctggtgatccgttcggtgctggagaagtaccagtatctggacaaaagagagcgtgcctttttaacgagagtggcggagggcaccattcagcgccagatcgaactggactatattctggatcagttctcaaaagtaaaggtcagaaaaatgaaaccggtgatccgcgccattcttaggatgggcgtataccagctgaaatatatggacagtgtaccggcatccgccgcctgcaacgaggcggtaaagcttgcgaagaaaaagggcttcggacagctgtccggtttcgtgaacggggtactgcgcggtgtttcgcgcggtctggatcagcttacatatccaaaggagagcgtcgatgccgtaaaagcctggtcggtgtgctactcgatgccggaatggatcgttgcgcagtggatcggcgattacggaaaggaacgcacaaaagagattcttgcagcgtcccttttggaagcgccgatcaccgtccgtgcgaatctggaacggatcacgccggaggcgctcgcagagcgttttaaggaggagggcgttaccgcggttccgctggatacggaaaaatatcccggactttcgtatgcatatacgatctttgggtttgatcatttaaacggtctttcaagctttaaggaaggactgttctatgtgcaggacatcagctccatgatggtggcggaatatgcggcaccaaaggagggcgatcactgcattgacgtctgtgcggcgccgggtggcaagagcattcatcttgcggaaaagttaagaggtaccggtcatgtggaggcacgggacgtcagcgaacagaaagtggcgctgattgatgagaatataaaaagatgccggcttacgaatatcacggcgaagtgtcaggatgcgactgttttggacgagacatcggttcgcacggcggatgtgctgattgcggatcttccctgctcgggactcggggtgctgcgcagaaagaccgatatcaagtaccgcatgaacccggaaggggaggaatcgcttgtggcgctgcagaggcagatactgtctgtggtgtgtgaatatgtgaagccgggcgggacactgatttattccacctgcacgattcacacggcggagaacgaggggaatgccagatggtttgagcagacgcacccggagttcgccctcgatacgatgcggcagatgttcccggaagaacatctcggggacggattttttatagcaaaatttaagcgaaagcaggacaacggataaggaatggaaaagacagacattaaatcgttgaatctggaagaactgaccgcatttgtcgagtcgctcggagaaaaaaagttccgggcaaaacagatttacgagtggattcacagaaagcatgtggcatccttttcggagatgaccaatatttctgcggctctcattgaaaaattgaatcagaactgtacgctgaccagcttaaaaaaggcggatgtgcagatctcgaagattgacggtaccagaaagtacctgtttcttctggacgacggcaatgtcatcgagagtgtcttaatgcgttataagcacgggaactccgtctgtatttcctcgcaggtcggctgccggatgggctgccgtttctgcgcctccacgctggatggtctggtgcgcggtctgcggccgtccgagatgctcgatcagatctatcagatcggaacggacatcggcgagcggatctccaatgttgtggtgatgggaaccggcgagcctctggataattatgacaacctgttaaaattcatcgaactgctgagcgatgaaaacggactcaatatcagccagcggaacctgacggtctccacctgcgggatcgttccgcgcatgcgggagcttgcggataaaaagctgcagatcacgctggcgctttcgcttcatgcatccaaccaggaaaagcgcctgcagctgatgcctgtggcgaacaaatatgacattaaggaagcggtcgatgcctgccgttactattttgaacagaccggccggcgcatcacgtttgagtacagtctggtggcgggtgtaaatgacacggcggaggatgccgcagaactggcagagcttgtgcgcgggatcaactgccatatcaatctgattccggtcaatccgatcaaggaacgcagctatagacagccggatgacggtgcagtgcatgcattccagaaaaagctggagagaaacgggctcaccgtgaccgtgcgccgggagatgggcagggatattgacggtgcatgcgggcagctgagacgcaagcatatgcacaaagagcaggaaatggagcataccgggcaggagacggggtgtgtcgggcaggagcagtaagtcttgccctttttcgcgttgtatgctaacattggtaattggataaatggcaggcaggtactgctattctaataatggaggaatagaatgaagacgttttccatgacgcatgtgggacagcggcgtgagacgaaccaggattatatgtacacatcagagacctccgtgggcaggcttccggatttatttctggtagcagacggtatgggaggccatgcggctggagattatgcttcgcgcttcacagttgaaaagattgtggaatacgtaacagaatccgaggagagcgagccggtgaccgtgctcggtgaggcagtcagatatgcaaatgaacatttgcttgcggaggcgaacgcggatgcgagcaaagcgggcatgggcacgacgattgttgcggcagtcgtggttggcgataagctctacacggcgaatgtcggcgacagccggttgtatgtgatcaaccaggaacgtatcacacagattacaagagatcactctctggtagaagagatggttcggctgggagagatggacaaagaggatgcaaaagtgcacccggataaaaatattattacgagagcgatcggcgtgcttccggaggtgtcggcggatttcttcgagacggtgcttgtgccgggagatacggttctgttgtgttcggacggtctgaccaatatggtcgatgatacggatatcaagcggatcgtgctgggacagcgtgatattgtggagaaaacacaacggctgatcgacgccgcgaacgagaatggcggtaaggataatataacggtggttttgattgagccgttttcagatgagactagatagagaatgaagttctttgtaaatcaggttggaggtttaatatgttaacagagggaatgtatatagcggaccgttatgaaatcatagggaaaattggtgccggcggaatgtctgacgtatataaggcaaaagatcttacgctcggacgttttgtggcaatcaaggttttaaagccggagttttcggaggatctgaattttgtgacaaagttccgcacggaggcacagtctgccgcgggattagaacatccgaatatcgtaaatatctacgatgtcggaagcgaaaaaggaatgcattatatcgtgatggagtatgtggaaggcatcacgttaaagacatatattgagaaaaagggccagctttcttttaaggaggcagtcagcattgccattcaggtgggaagaggtattgaggcggcgcacagcaagggcatcatccaccgtgacatcaagccgcagaatattattatttctacagaaggaaaggtaaaagtaacggatttcggtattgcgcgtgcagcaagcagcaacacgatcagttccgatgtgatgggctccgtgcattattcttctccggagcaggcacgcaacggatttgtggacggcaagagcgacatctattccctcggtattgtgatgtatgagatggtgacgggacgtgtgccgtttgacggggatacgaccgtggcggttgccatccagcatctgcaggaggagatcgttccgccgagtgcctacgctccgaatcttccaatcagtatggagaagatcattttaaaatgtacgcagaagaatccggaccgccgttatgagtccatgacggcacttttgacggatctgcgcaaggcgcttgtcagcccgaatgaggattttgtcgtgatggttcctgcaaccaaccaggacaagacgcgcattatcggagaggacgacttaaagcagatcaaggaggaggcagacagcctctatcttaaggcggatcaggcggtgcacgcgagagcggaggagatgaaccgctacgatgaggatgaggacgacgcagaagatgtggacgatgatgagctggatgacgaggatgacggcgatctgaatccgaagatggagaaagcgattacgatcatgggaattgtcgcggcagtcgtgattgtgattatcatcattgtgattgtggtaaatctgttcggcggaatcaagtccaagaagcagtctgatacggagacgtcgcgcacagagaccacgcagaccgagagccagaatgcagatacggttaccgttccggatttccgcggtacgacttatgcggatgcgcagaccgaggcggagaagaagggattaaagctggagaacaagggcgaagtatcctctgacgactatgatgagggagagatcgccaatcaggacccggagagcggcaaggaagtcgaagagggcacgacgatcggcgttgtgatcagcaacggcaagggcagtgtggaagtgccgagtgtgaccggagactctgaggatgatgcagtgtctgcattggaaaaggaaggtttcaagccgaacaagacatacgcttacgatgacagtgtggaggagggaaaagtcatttcccagacaccgtccgcaggtgataaggcaaaaacaggtgatacgatcacgatcgtcatcagccagggcgcagaggcagtgaccgttccggatgtgaagacgacctacaagtccgaggagcaggcgagagatctgctgtcggattttaatgtgacggtcaagacggcgtacagtgatagttacccggaaggcattgtcatggatcagagtattgatccgggcaagcaggtggaaaaaggcagcgacatcacgatcacggtaagcatgggaccgtcaccgtcccagagtgtgacagcaacgacctacagcttcaaggcgacgatcaacctgccgggcgatacgtccaacgtatccggcgcaacaatcacgctgtatgatacttccggcaatgtgctgggacagtggaataaggcgatcacagatgatttttccatcagcaagacgggactgcttgcaaaagagggctatctggtgatctcatggctggatttaaatggcaacaagatcaacgatcagaccacgagcacctaccagtttacaccggaatcataatggataagaatatgcagggaaagattgtaaaaggaatttccggattctactacgttcacgtagcgggatccggaatttatgaatgtaaggcaaaaggaattttccgcaaccagaagatcaagccgctggtgggcgataacgtgacgattgctgtgctggatgaggagcagatgcttggaaatattgaggagattcttccgagagaaaatgccttgatccgtccggcggttgccaacatcgatcaggcgcttgtgatttttgcggcggcaaagccgaagccaaattttaatctgctggaccgttttctgattatgatggaatatcagaaggtgccggttacgatctgttttaacaagtgtgatcttctgaccggggaggagctgcacgcgttttcggatgtctacgaacagtgtggctatccggtggtgtatacctcggcgagagagcagcggggaatcgatgtgctgcttgagcggctggaaggaaaggtgacgtcggtggcaggaccctcgggtgtgggcaagtcatcgctcatcaactgtctgcagccggagcgccagatggagactggggcaatcagcagaaagattgagcgaggccgccatacgacccgccactcggagattattccgattaaagagcagacttacatcatggatacgccgggattttccacgctggatattccgggactggaaaaggaagatctgtggtggtattatccggaatttgaggagtatgagccaaactgccgttttaagggctgcagtcatatcggggagccggactgcggggtaaaagaggcggtggaagccgggaaaatcagccggctccgttatgagaattacaggcagttatatcaggaattaaaagaacagaagaaatattaaaaagaagggtgtaagagagatgaattgtttgtcgccatccatattatccgcagatttttcaagactgggagagcagatccgtgaactggacgaggcaggggcacagtatgtacatattgatgtcatggacggaatgtttgtgccaagtatttccttcggacttccggtaatccgctccatccgtccctgtacggaccggatcttcgacgtgcatctgatgatcgaggagccggggcgctatattgaggattttgtcggagccggagccgatctgattaccgtgcatgcagagagctgcaagcatctggaccgcacgattgcttccatcaaagagcgggggattcttgcgggggttgcgttaaatcctgctacgccgctgcagacggtggagtatgtgcttgaaaaagtggacatggtgctgattatgacggtgaaccctggattcggcgggcagaagtttatcccgtataccttgcagaaggttcgtgatcttaagaaaatgattgatgcgcgcgggttgaaaacagacattgaggtggacggcggggtcaatctctccaacgtggaggagattatgagtgccggcgccaacatcatcgtggcgggaagcgctgtttttaacggagatgtcgctgaaaacacccagatgtttctggatattttaaattcttaaggaacggcgggagaaaagcgggggagcgtatgaaacattttgtaataatttcaggcggaacgatcgacgattcttttgcggacagatggtttgaggaagagaagccggatgccgttatcgctgcggatgccggaatggaatatctgtaccgcagccaccgggtgccggatgtgattgtcggggatttcgattccgtgggaacggaggctcttgcttattttaagacattgcccggtgtggcgatccagaagctgattccggagaaggacgacacggataccgagtctgcaatccggcttgcgatccggcgcggagcagagcgcatcacgcttttgggagcgacggggacacggctggatcatgtgctggggaatatcgaactgcttggaattgggctaaaggcggggattcccatccagatctgcgatgcccataaccgcatctgtatgattgaccggggaatgactcttgcgagaaaggaacagttcggaacgtatgtgtcgctcattccctatacggaatgtgtggagcatctgacgctgaagggatttaaatatcccctcacggacgcctgcctgcgtggattctgttcgcttggcgtgagcaacgagatcgtggcagatacggcagagatctcgtttgagagcgggattcttcttgtggtggaatcaaaggactgatgacagaagaggattgccgcaataataagcatagaactctttttggggataagtaatattatcagaatatcacaccgtgggatttcagatgaaaatgcagctggaaattcggttcaaaaaatgtggcatttctaaccagccggatgtttgcatcttcgatgatccgtgtctttccaagtttggagcactccgcgggtcatgtccgcatcccggaagacaatttgtaggacttttgtgtgtgtccctaatggcacctctgaacagaacataaccgtgcgaagccgatgtctgtgaagaggtgccattagggacaccagaaagtccgcccattgtctccggtgtgtcggacatgcacccgtcggattgtccaaacgtggaagagacacggaatccgatgcaaacattcagccggaagaaatgctcacatttttctccaacgaatattccatctgcatttccacatgaaatcccgaagtgtattctgataatattacttattaaagctgttaaagataataaacaggatcatgtgtccaaagaattggacacatgatgcgatacactccttttatcagatgacgaaaggagtgtattttttatgaaaggatatgttgtagcggcaggctatatgggatatgtaaacggagaatacatgctcttctcgaatgaggatgactacagagaatattttgaagattagagataaaatgagataaaagaggaaattgccacatgcccaaaagccggtcgtagcgaacggaaggaagcttagaacgctgtctgcggatattgaaattttaaatgggatgtgggataatgtacgcgtaggcaatgagcgggctgcccggcgaagtaaagcagccgccattggtctatgtattgcaaggaaagaaggaattcagatgtcagagaaggaaatcgaactctatggaaaacaggtggatgagatcaagattcggccttatgagcatcacgccaagtattacgagacggatcagatgggcatcattcatcattccaactatatcaaatggatggaagaggcgcgcatggatctgatggagcagatcggactctcctataaggagatggaggcgatggagatcatcagcccggtgctgtcggtgtcctgcgagtatcacagcatggttcattttgatgatgtggttgtcattgagccgcggattaccaagtataacggaatcaagatggaagtggagtaccggatgacggataaggcgacgggagaacttcgcactacaggaacaagttcccactgctttttgaaccgttccggaagaccgatttcgttgaaacggtcttatccggagattgatacaaagttctttgagtacacagatatttagaacaaaatggagcggatagacgctccggaatggagaatactatgattcaggaaagattaagcgcattgcgcgaggagatgaaaaagcggaagatcgatatttatattgtaccgaccgccgattttcatgagtccgaatatgtaggggagcattttaaagccagaaagtttatcaccggtttcaccggatcggcaggcacggcggtcattaccctgacagaggcaggactgtggacagacggacgctatttcgtgcaggcggaaaagcagcttgccggaagtaccgtgatgctctaccgcatgggggaagagggtgtgccgaccgtggatgagttcgttgaaaaagaactgccggagagcggctgcatcggatttgacggcagagtggtgaacggaagctggggcagaaagcttctcgccattgcggagaaaaagaaggggtctttgtacgtgacggaggatctgattgatctgatctggaaggatcgcccggcgctttctaaggaaccgctgtttttgcttgaggagaagtactccggcaagagcacggcagacaagatcgcggatctgcgcaaggtaatggaaaaagagggagccaatgtgcatattctgacttccttatacgatatagcatggctgttaaacatccgcggcggagacatcgattacgtgccggtcatcctgtcctacctggtgcttaccgacaaggagtgcatctggtttttacaggaagaagttgtggatgagaagattgcagcatatctgaaggagaatcacatcacaaccagaccttacgatgcaatctatgattatgtgaaagagatcccggcggacgcatgcgtactgatgaatggcaatacggtcaactaccgcattaccagcagcctgaaaaaagagatccgcattgtggaccagccgaacccgaccgagatcatgaaagcggtcaagaatccggtcgaggtggagaatatccgcaaggcacatgtgaaggacggtgtggcattcaccaaattcatgtactggctgaagaccaatatcggcaagattccgatgacggagatctccgcatcggattacctggaggcgcgcagaagagagcaggataactttatcgagttaagctttgacacgatctgtgcatacggaccgaacgctgccatgatgcactatgcggcgactccggaatcggatgccgagttaaagccggaaggcttcctgctggtggattccggcggacactatttcgagggaacgaccgacatcacaagaacgatggcgctcggaccgatcacagacgagatgcggctgcattttacaacggtatgccgctccaacatgaaccttgcaaacgccaagttcctctacggctgcaccggactgaatctggatattttatcccgcgggccgctctggcagatgggcattgattacaagtgcggtaccggacacggtgtgggctacattttgaatgtgcacgagggaccgaacggcttccgctggagagtggtgccggagcgccatgataacggcacgctggaagagggtatggtcacgacggatgagccgggcgtatatctggaaggcaagtacggtatccgtaccgagaacgaactggtatgccacaaggcggagaaaaacgagtacggtcagttcatgaattttgaaaatattacttacgcaccgattgatctggatgccattgatccggacgagatgacgggacgtgagaagaagatgttaaatgactatcatgcaatggtatacaagacactctctccgtacatgacaccggaagagaatgagtggctgaagaagtatacaagagcaatctagaaacggagacagaaatgagcgaaaagctggtattgattgacggacacagtattttgaaccgggcatttttcggaatcccggatctgaccaattccgagggacttcacacgaacgcggtatacggatttttaaatatcatgttcaagatactggaggaggagcagcccgattacctgacggttgcgttcgacgtgtctgagccgacgtttcgccacaagatgtttgcggaatacaagggtacccgcaagccgatggcggcagagttaaagcagcaggtacccctgatgaaagagatgctgcgcgcgatgggtgtgaccatcgttgaaaaaggcggttacgaggcggatgatctgcttggaaccatcgcaaagcgcagtgaggcggcaggcgtggaggttgcggtcgtatccggtgaccgtgatcttctgcagcttgcaacagatcatatcaagatccggatcccgaagacgaagaggacgggaaccgagattgaggactacaacgcgaaggaagtcctcgagaagtatcaggtgacgccgacggagtttattgatgtgaaggcactgatgggtgatacttccgacaacattccgggagttcccggcattggcgagaagacagcgacggcgatcatcgcaaaatacggcagtattgagaatgcctacgcacatgtggatgaattaaagccgccgagagcaagcacgaatttaaaagagcattatgatatggcgcagatgagcaagacgctggcgacgatcgatatcgatgcggacattgcctacaagcttgcggacgcgcatttagaacaggtttccgatctgtatacagaggaagcctatttgttgtgtaagagactggaatttaagaatctcctcggcagattctccgtggaagcaccgaagaatacggcggaggagcattttaagaagatagaaaaggcgcaggaggcagaagcattttttgcatccctgcgtggaaaagcatgtggattctatgtggtgccacaggaggaaacgcatgacgcccacacggaggctgacggtcagatgaatctgtttggcagctttgcgatgcagaactccggcgaagaggcggggcagcaggagacggcaggaagctgtcatatcccggattttctcggacttgcagttgcatgtggtgaggaggaaatctgttacgtggaggcatcggaagcacttccctgccgtaagatccgtgaattgtttgcggggagcgcagccgcttcctatgcgacacttgacttaaagccgcagttaaaggaactggggatgcttgagaaaaaatgtcttggaacgatctcggaggagaacctgttcgacaacacgatcgcggcctaccttttaaacccgattaagaatgaatatccgtatgaggacattgccaaggattatgcgggactgatgattctgtcgagaaaggatctcatagagaagctcacgtatgagaaggcggctgagaaaaagccggaggaatttttaaagtgcgtctgctatatggcatacgtggcatacaagaccagggagccgcttgaaaaagagcttgcggacaccggaatggaagcgctgtttcgcgagatcgagatgccgcttgtcttcacgctggcagatatggaaaaagagggaatcattgcgtccggggaggcgctaaaggagtacggagacaagcttgccgtgcgcattgacgaactcgagcgtaagatctatgaggaagccggggaggaattcaatatcaattctcccaagcagctcggtgtgattttatttgaaaagctttccctgccgaacggcaagaagacgaagaccggttattcgacggcggcggatgttttggaccgtctggcgccggattacccgattgtggcggatattctggagtacagacagctgaccaagctaaagtccacctatgcggacggtctggtgaactatatcgcagaggacggaagaatccacacgtccttcaatcagaccatcacggcgacgggacgccttagcagcacggagccgaacctccagaacatcccgatgcggattgaactgggaagactgatccgcaaggcatttttgccaaagagcggttttgtgtttgtggacgcggattattcccagatcgagctgcgcgtgctggcgcatctgtccggggatgagaagctcatcgaggcataccggaatgcacaggatattcaccggacgacggcgtcgcaggtattccatatcccgtttgacgaggtgaccgatctgcagcgccgcaatgccaaggcggtcaatttcggtatcgtctacggaatcagctccttcggactcagccaggatctctccatcacgaagaaagaggcggcggagtacattgagcgctattttgagacctatccgaagatcaaggggtatctggacggactggtggcggaggcaaaggaaaaaggctatgtcacgacgatgttcggaagaagacgtccgattccggagctttcttcgagcaattttatgcagcgttcgttcggggagcgcattgcgatgaattccccgatacagggaacggcggcggacattatcaagatcgccatgaaccgggtgcatgaccgcctgctggcggaggggttaaaatcccggctgattctgacggtgcacgatgaactgctggtggagacagcggtagaggaagagcaggaagtgcgtaagattcttgccgaagagatgcacggggcagcacagttgtcggtgatgcttgagattgatgtgcatgcgggaagtgactggtatcaggcaaaatagaggtgcagtaaaacgatgagatttataggaattaccggcggtgtaggagccggcaagtcggaaatactgggatacctggcgaagaagccggatacccgcgtgatgcttgcggatgagatcgcccatgagctgatgtctcccgggacggagtgctatgacaggatctgtgagacgtttggcgcggaggatattttcctgccgcagggcggactgaaccgggggaaactggcggcagtcattttttccgatgaggcgaagcgcaggcagatgaatgccattgtacacccggcggtgcgcgtctatgtggaaaaagaggcggcgagagaaaagcagggtggaaaacgaaagcttctggtgctggaggcagcgcttctgattgaagaacattatgatgaaatttgtgacgaactctggtatatttataccagagaggatattcgcagagaacgcctgatggcaagcagaggatattccacggaaaaggtagaccggatttttgccagccagttgacggaggaagtctaccgggagcactgcagggttgtgattgacaacaacggcagtgtggcggaggcttttgcgcagattgacagggcgctttcggagaagaaatagagattaggagatactgcagatgagcgatacgagcgtattcgaccagccgctggtgtttggtcttgatattggaacgagaaatgtggtgggaaccgtaggctataagacggagaatgaatttgtcgtggtggcacagtatatgcttgagcacgagacgcgtgccatgctggacggccagatccatgatatcggacgcgtggggcataccattgccaaggtgaaggaggagctggagtcacagatcgggcaggaactgaccgaagtgtgtattgcagccgcaggccgtgtgttaaagacggtgacgaccaacatcagctatgatttcccggaggagacggtcgttaccggcgaggatattcatacactggatctgcttggaattgaaaaggcacagtccattttaaaggaaatgaacgatacccgctacaagttttactgtgtgggttattccgtcatgaagtatttcttaaatgatgaaccgttctccagtctggaatcccataaggcagaacgtatcagcgaggatatcatcgtgacgttcctgccggaggatgttgtggacggtctgtacgcggcagtcggtatggcgggtctgaccgtggcaaacatgacgttggagcctattgcggcgatcaatgtggcgattccggagaattacagactgttaaatattgcgctcgtggatatcggtgcgggaacatccgatatttccgtgacgagagacggaagcatcatcgcatacggtatgattccgcttgcgggggatgagatcactgagctgatcgtgcagagttatctggtggatttcaacacggcggagcagatcaagctctcgagcggtatggacgatcaggtgacctacaaggatattatgatgatcgagcacacgattccgtcgaaggatgtgtggaagctgacggagccggtggtggataagatgacgaccgaggtagcggcgaagatcaaggagctgaacggagacaagagcgtcagtgcggcgtttatcgtcggcggcggcggtaagatccacggttacacggagatgcttgccaagaagctggatctgccggcagagcgtgtagcgctgcgcggtgaggaagtgctgcaggaagtgacgtttcttcagacagagatccagaaggatccgctgctcgtcacgccgatcggtatctgcttaaattattacgatcagagaaacagctttatcatggtgcgctttaacggggagcggatcaagctgtatgacaacaataagctgacaatcgtggatgcagccctgcaggccggtttcccgaatgaggaactgttcccgaagcgcggcaaggaactcaatttcaccgtgaacggcactccgcggattgtcagaggtgagctgggagagtccgcagagatctatatgaatgaccgtctggtcaacatcaacaccccgctggaaccgaacagcgacatcgtgatcgaagcgtcgacacagggcgaagcggcggtatgtaccttagagcagctggatgagtattcctcttcggagatgaaggtaatcgtcaacggcaggatcgtgcgctgtccgaagtgcctggaagtcaacggaagtctggaactgccgtcctatgagatcaaagagggcgatgcggttgagacgagaagcttttataccgtggagcagctggcggcattcatggatgtggaagtggacatggatcatgagattcttgtgaataaccgcgtggcaaccatggagagtcttgtgtacgagaacttttccgtggactgggtggtgctttctttcggagcagcggcggtggatccggcagaacttccggttgcggagcagcctgtgacggctgcggctggcgggacggagcagacagcggacgagactctggctgagacggtagaggaagtggatgccgcagagagtgaggcacagaccggtacagaggcggaggaagcggagcatggaatgtcacaggaaccttcatctgtgacagatgccacgggagcagagagcgctgtggagcagccggctgaaggggaagtgcagcaggcttcgcagaagacggatctgggactggttgtgtttatcaatcagcagccggtacgtctgaccggaaagaagagctacatctttgtagatatttttgatttttacgattttgatttaacggcatctgcgggaagagcgatcatcacaaagttgaacggacagcaggcacagtattcggcagtgctctccgagggagaccagatcgagcttcgctggcaggaaattaacagatagagagtggaagaaataaaatggaattatgcagtatagcaagcggcagcagtggcaactgtatctgcgtgggaacagatgaatgtcatgttttagtggatgccggaatcagcggaaagcggattgaatccggtctgaattcgattgatctgaaaacggaagagatgcagggaattctgatcacacatgaacatgtggatcatatcgcaggacttggcgtccttgcgagacgttacggtctgccgatgtatgcgactccggggacgatcgatgcgatactgcacaccaaatccgtcggaacgatcgatcccgccctgtttcatgagattcatgcgggggaggattttacgatcggagatatgacgatcgagccgattgccatctcacatgacgcggctgagccggtggcgtataagatgaagcagcccggaaaatccatggcggtcatgacggatctgggaatttatgacgaccatattgtggagaagttaaaggggctggacgtgcttcttctcgaggcgaatcatgatgtacatatgctgcaggtcggaagttatccgtatccgttaaaacagcgtattctcggagagaagggacacctgtccaacgagctttccgggcggctgctcggggaggtgctgcacgatcatttcggcacggtctttttaggacatctgtccaaggaaaataactatgcggaacttgcgtacgagacggtacggctggaagtggcgatgggagataatccttataagggggatgattttccgatgtatgtggcaaagagagacgagccgtccgagctggtgcggttctaaggtgggagaaaagaaattgcatatgccggcagacacggatatcataaaagaaacaggcgaagagctcttttggaggcaggcgccggaattgaggtagtacgaacaagatgatcaaagaatccgatattcagaattatctatacgccaggaatattccttacaccgaccatgcatcaatctatgcggtgattctgccaaagtattcctttatgcggacgatgatggcgacgatgcttgaggtgcagcattttgtcattcatttcggcaggacgggcatttctgtgatcgtggtgaatgatctcaccggcagactcgacccgtatgggtttttgtttttcccgggggagagaattcagagcgtgcagtttttccggcgggtgacgcacgatcagcttgtgatccggctgacggacggtgtgcgcgtctaccgggtgaataagagaatgatgatgctgccctggcacaaaagcaatctaaaagcattgacttataaaagccctgtgtattataatcagtgttaatacgataaagtgataacgtggaagcaggaggaatgagattggcatggagaatacagtagacaaagtaatcataacagtcgttggaaaagataccgtcggtattatcgcaaaggtatgtacctatctttcggagaatcatatcaatgttctggatatttcgcagacgatcgtgtccggattttttaacatgatgatgattgtggacatgagtcagtcatcgagatctttcggggactgccagaaggatctggatgcggtaggggagcagatcggtgtgtccatcaaatgtcagaaggaagagatttttgaaaaaatgcacagaatctaggaaaatgtgcaggaagatcgaccgatggacataatgtccacagaaagggatagacggaatgattaacatatgggaagtaaatgagaccaacaagatggtggagcaggagaatctcgatgtccgtaccatcacgattggtatcagtcttttggagtgtattgattctgatttaaaaaagctcaatgagaatatctacaaccggatcacgaccgtggcgaaggatctggcggcagtcggagagaagattgagaacgagtacgggataccgattgtcaataagcgtatctccgtgacaccaattgcactggtgggcggtgcagcctgcaagacgccggaggattttgcgacgattgcggacacgctggaccgcgcagccaagacggttggggcgaacttgatcggaggctattcggcgctggtgtcgaagggtatgacgaaggcggatgagatgctgattcactcgattccgatggcactctgccggacagagcgtgtctgcagttcggtgaaccttgcatccacgaagaccggcatcaatatggatgcagtcaagctgatgggagagattctcttagagcttgcggagcagtcaaaggaccgcgattctgcggactgcatgaagcttgttgtattttgcaacgcaccggatgacaacccgtttatggcaggcgcgttccacggtgtgacggaggcggatgcgatcatcaacgtcggtgtcagcggaccgggagtggtgaagactgctctggaaaaagtgcgcggcgagaacttcgaggtgctctgtgagaccattaagaagacggcgtttaaggtgacgagagtcggacagctggtggcacaggaggcatccagacttcttaatatcccgtttggtatcgtggatctgtctctggcgccgacaccggcgatcggcgattccgtggcggacattctctgcgagatcggacttgagtatgcgggagcaccgggaacgactgcggcgctcgccatgctgaacgatcaggtgaaaaagggcggcgtgatggcttcctcctatgtcggcggattaagtggcgcttttattccggtcagcgaggatcagggcatgatcgatgcggtacaggcaggagcgatcacacttgagaagcttgaggcgatgacctgcgtatgttccgtgggactcgatatgattgcgattccgggagacaccaaggcgacgaccatctccggtatgattgccgatgagatggcgcttggcatggtcaaccagaagacgactgcggcgcgcctgattccggttatcggaaaaggggtgggcgatacggtagaatttggcggactgtttggctatgcgccgatcatgccggtgaaccagttctcctgtgacgcgttcatcaaccgcggcggcagaatcccggcgccgatccacagcttcaagaattaaaatataacgaacatgagtcatggaaaataagtgatagaaaacaaccttctctgatcagacagaatccgaaaggatgattcagggaggttgtttttcctttatccggacagaggaagcacagaatggcagagatcagaaaaatcattttcataaaaaatgcggtggagacgctgggatatttttccgaacagattgcacgagaactggagaggaacgggtatgagacctgctttatcgactatgagcggatgtatgagtcgatggatgtaatgctgcattttctggaccgggaagagacggcacttgtcacctttaatttcatcgggctgcgcggggaggctgtgtttcaggcggagagcggacgcagtatctggcaggaggagaaccttcccgtcttaaatatcttggtggatcatccgctctactatcacagctgtctgaaggaagccggggagcggatgcgggtattctgtgtggacagagagcacgtcggctatgtgaggcgtttttacccgggggtgaaggtggagttcctgccgctggcgggcaatgaacttcttttttcgcatggagacggggaacacggaacgcacagagcggatgtgccagagcctgtgctgtatgggcagagaacctttgaccttgtatttgcggccaactatgtgtcgatggagatgctggaggaaaaagtaaaggcgctggatgacgattatcggatcttttaccggcggatcacggaagatctgatcgcggatcccgcgcagtctgtagatgcggttatggagcggcacatccgcaacgagcttggggcagtgccggaagagcagctttgcgcagcgatgtccgggatgatctggattgatctgtttgtccgcagctatttccgggaaaaagtagtgcagacgctcgcggatgccggtatcatagtgcgggtattcggagcagactgggagaaaattcactgcaaaaagccgcagaacgtgcggacgagtggcggaaaagtgaactcggcggcgtgtgtgcaggcgatgcgtgacgccaggatcgcgttaaacgtgatgccctggtttaaagacggagcacatgaccgcgtctttacggcgatgctgcagggaacggcggcgctcacggacgacagccggtatctgcgggaagagtgccgggacggagaaaatatctgcttttactccctgagggcgttacaacagcttccggatcaggtggtaagcctgcttgaggatccggtgcggatggcagagctggcggagcggggatatcggatggcagaaaagcggcacaggtggaagaaccgcgccgggcttctgatgcaggcgcttcgcgatatagataagtaaaactaatagaattcagtaaataaattcatgatactaatgacagcgcattccttgtaaaaagaaaatccgcatgataagatggaagaaggcaatcaatgtagcaatgtgtgatgtgaaggaggaaaatcatgaagatgatgtcacttgcgaaggaactttcgtccaatacatatccgggaagaggaattgtgattggcagatccggggatggaaaatatgcggtaaccgcatactttatcatgggaagaagcgagaacagccgcaacagggtctttgtggaggatggtgaaggaatccgcacacaggcatttgatccgtccaagctgacagatccgagtctcatcatttatgcaccggtccgcgtgcttggcaacaagacgatcgtgacaaacggcgatcagaccgatacgatttacgaactgatggacaagcagcagacattcgagcaggcgctgcgcaccagagagtttgagccggacgcaccgaactatacaccgcggatttccggtatcatgcacatcgagaacaatacctacaactacgcgatgtctattttaaagagtaacaacggcaatccggacgcctgcaaccgctatacgtttgcataccagaatccggtggccggcgagggacattttatccatacatacatgggagacggcaatccgctgccgagttttgagggagagccgaagcttgtcggcatcgagggagacatcgacaccttcacaaacacggtctgggagaacttaaacgcagacaataaagtatctttgtttgtgcgttacattgagattgagaacggaaaatacgagacgagaatcatcaacaagaacgtgtgaggagaataggatcatgaaagaattagaattaaaatatggctgcaacccgaaccagaagccgtccagaatctatatggagaacggcgaactgccgatcaaggtgctttgtggcagaccgggttatatcaattttctggatgcattcaacggctggcagctcgtgtccgagttaaaaaaggcaaccggtcttccggcagcgacctcctttaagcatgtgtcgccggcgggcgcggcagtcggacttccgctttccgaggtggagcgcaagatctactgggtggatgacatggatgtggagtttacaccgcttgcaaatgcctatattcgtgcgcgcggcgcagaccgcatgtcctcgttcggtgattttatctctctttcggatgtctgcgacaaggagacagcgcttgtcatcaagcgggaggtatcggacggcgtcattgccccgggttacaccgatgaggcacttgagattttaaaagcgaagaaaaacggcaattacaatgtcattgagatcgatccggattatgtgccggcaccgatcgagcataaggaagtgttcggaatcacatttgagcagggaagaaatgagctggtgatcgatgaacatttcttcgacaatattgtgacggagaacaaggagattccggaggcggcgaagagagatcttgccattgcgatgatcactttaaaatacacgcagtccaattccgtgtgctatgtcaagggcggtcaggcgatcggtatcggagcggggcagcagtccagaatccactgcacgagacttgccggttccaaggcggacaactggtggctgcgtcagtcgccgcaggtactttcccttccgtttaagccgggcatcaaacgtgcagaccgggacaacgccattgacctctatattggcgaggattacatggatgtgctggcagaaggcgcatggcagaatatttttacagaaaagccgcctgtgtttaccgcagaggagaagcgggcatggctggataagaacacagaggtatctcttggatcggatgcgttcttcccgtttggcgacaacatcgagcgcgcacacagaagcggcgttgcgtatgtggcacagccgggcggttccatccgcgacgatcatgtgattgagacttgcaataaatatcatatggtgatggcatttacgggaatccgtctgttccatcactaggaagagccaaagagggctgatgtatgcagggtgcatcagcccttttttatttcataggaaataccgtgatacattcatgtgtgaaagtagaaccttcctatgaaataaaaaacgctccgcgaggatgcgcagctcgcggtagggaaaatatcgctttgcgaaccgctcgcgcgcggagaatctcgcaagcgagattcttttttacactttttttacaaggctttaccggacaagggtagaagagaagattcataaacgttacagtttattttacatacaagaaaatgagaggatagttgtgaaaatgaagaaaaagaatcattggaaaaacttatgtgcgcttttcttcgcagtctgcatggtgttttcgacagtagcaggagatgcgtcttttgttactgctatggcagcagaggtgcagacagcggccggaagtgaagcggcggaaaatccgtcaccggcagaggagagcggagcagacagcacggaaggtgcacagaacacaataaatcaagaaagtgcggcgcagacagggaacgccggtcagacggacgcagcgcaggcagagggtgcagtgcagacggatgcagcgcagacagatggtgcagcgcaggcggatgcggtacagaatacggagtctggggcagaccagaatacggcgctcatccagacggcgggtgcagaaagccttgcggccttcagttatacggcggcaccggaagcgggacttccgacagcagcgacagcgggcagcggaacgcttgacgtaagcggagcatcttacagcggattcagcaagggaatcgcagcaaaaggatggagcgagggagcgggctttacggttgcggtcaatgctgcaggttacacagatttaaaattttctgcagacatgcgctccagcggaaccggtcctgccaactttgcactggaatattccattgacggagcaagctggacaaagatcagcggaacggatgtgaccttaagtacggatcttgccccggtgtatcagcagacggtactcccggcggcactgtccggaaaagcgtttacactgcgtgtgacaatgcagggaaatacaagtgtgaaccagagtacagtcggcacgaacggtgtgaccagcatcaacaacattgtagtcaccggaacacagggcgaggcggcgacagacggaacggtctgttccaaagtcaaagcttccgtggagccgggagatgtggaagccggtacgaaggtggagctctcctgtgcgacggagggagcaacgatcacataccataccgatctggacagtgcagacaagacatacaccgaagcgcttgtgatcgaggaagatgtgacgatctacgcgacagccgaactcgaaggttatgagacgagtgagacggcagaatttgcctacacggtaaaacagggtgcaaagagcaaggaggcagcacttgccaccacactttcggacggaaatattgtcgccctctattacgagaacaacggaaccggaagcgtgctctcccagaccgcaagcggcaagaagttaaagggcgtgtcagcgactgcggcggatggtgcgcttgccattccggaagatgcggcagaacttacggtttccgtggatgaaaacggctattatacgtttacatgcggtggaaaatatctgacgtccggcgcaacgggcagctccgtgacgtttgcggacgcggcgggagattacagtctctggaagctgcagaaggcaaatgagaacggcggatactatgtgatcaatgccaacgcaaaatataataataccacagaacagtatctggaatattacagcggttttacgacatacagctacaaatcatcttcggatgcggcgtatgtattctatttttatctgatcgatgagggaacaccgtcggttcatatccgtgcggacgagtccgtcacggaaaacgtggcacagtggtccggaacggcagattacaagacggcaggtgtgacggcagataccggaattgcaggagattctctcaatgcaaatgatctgctggatgcggatgctatatattcggcggtggtaaatggaacggcagtggcaccgtataccgaggccacaagcacttccaccggttcgacttcctattatatgggaggaaagggcattggaagcggaagcaatgattatgcgcagtttgtgatgccgacaacgggctatgccaacatggtgctcgcattccggcttcgcgcaagcaacaccggagcaggttccttccagatgcagtattctacggacggtgtggattttaaaaacctttccacaggaacctatgcttataagtacacgaaatacgtgggcggtgagccgcaggaagtgagcgccgcggagaaaattaccgacggtgtggcaaagacaagccttgcgccggcaaactatatttcgttcacgtttgatattccgaacgaggcggcgaatgcagaccgtctctacatccgcatggtcccgggcagcctttctgccaagggagataaggcaccggcagcgggcggagtgatccgtatggacacggtgacagtgacaggcaatccgctgatcgcctcagatctctgcggatatgtggcagcagaaccgcagagcggcgtggtagctgtgggcagtgaattgacactgacaagcgccacggagggtgtaacaatccattacagtgtaaacggcggcgcggagcagatctatgatgcgtcggcgaagccaaagcttgcagaccttccggcagttgtgactgcctatgcgacaaaggacggctataaggacagcatccgccgtacattctcttatcagcaggcacaggtggcaacggtaaaagcaacgccgaacggcggcagcgtggtgaaaaataccgcggtgaacctcacctgtgagaccgagggtgcgacgattcagtattccgcggacgacggtgcaacctggcaggattataccgaaaagctcgccctgacagagcttccggttacctataaggtgaaagccgtcaaagacggttacctggacagcagtgtgctcacactttcctttaccgagcgcacaaacgaaaaatatcagatttactttggacagttacattcccacacttcctattcggatggtgcgggaagctgtgaggatgcataccagcatgcaacgaacgttgacaatctggattttgttgcggtgacagatcactccaactcgtttgacaatgcggacagcgcgtccatctcggacggctcgatgagtgaggaatggaaggaaggccatgcgcttgccacgcagtatacgacaagtggatttgtgtgcatctatgggtttgagatgacctggtcgaacggacttggacacatcaatacgtttaacaccgaaggcttccagagccgtacccagaatgagtacaagacttacagcacggcattgcagaattattacgcgaccttaaagacacagccggattccatcagccagtttaaccacccgggaacgacgttcggtgatttcagcgatttcgcatactatgacgaggagatcgacaagctgattacgacgatcgaggtcggaaacggcgagggtgcgatcggaagttcgggttacttcccgtcctacgagtattaccagcgcgcgctggacaagggctggcatcttgctccgaccaacaaccaggataaccataagggcttgtggggcgatgcaaacacggcgcgttccgttgtccttgtggacagcctgacgcaggaaaatatttacgatgccatgcgcaattaccgcgtgtatgcgacagaggataacgacctcagcatctattacacgctggacggctacatcatgggttccattttagaggatggagcgaccggagataccgtacatctttccgttgacttaagtgatccgacggatgcgtccatcggtaaagtacaggtcatcacaaacggaggactggtgcttgccgagaaaaatgtttccggaaacgaggagacggtcacctttgatgtgaaaaatgattattcctattactatattaaggttgtggaagcggacagtgatatcgccgtgacggcaccggtatgggtaggctctgtggaggcggcaggaattgacagcttttccacggacgaggtgcttccggtaaggggagagccgctgacggtgaaccttggactctataataatgaaaacagcgagctcgcgattgattccataacgtttgaggtgggcggagagaccgtacatgaggcggatcttgccgcagcaggattgggaagcgtcgcatccatgagcacgggaagctacagctttgactatacctatgacggcgtcggcagcatggagatgacagcagttgtgcatgcgacgatgaacggcgtgcagaaggtatacaagagcgtcttaaaattaagctacgcgacaccggagatggtgacaaaggttatcatcgacggaacccattacaacgattatgtgaccggttactatggcggtaacgtcggaaactttacggcgattgcgggagcaaagaacgtcaaggtggaagtggtcacagacgagattacgccggagatgcttgcaaactgtgcgttgcttgtgatctcggcaccggcgaagaaatccgggacagcaaatgccggagattacaccgtgtcgcattttgaagacagctttatccagatggtaaaagactataccgacaatggcggtacgctgattacctgcggtattgccgattatcaggattctacttcgggacagacagcgacagagatgaataagcttttggctgcgatcggggcatcgaccagattaaacagcgacgaggcgtacgatgagacgaacaacggcggacagccgtaccgcttatatctgaaaggaacctacaacaaggattccagatatctgcgcggcgcaagcgaggagcaggagtacagtgcgtacagcggatgtaccgtggcgctggatgcggatgcggtgacagccggacgtgcggaagcgcttgtgagcggatatgatacaacgtattcgatcgactgcaaggatgatgcgggaaacagagttaccggaagcccgacgtatgtggaaaaaggcaatatggtagcactcgcacatgagacactgggaagcggtgcaaatgtctttgttgcgggaaccgtatttatttccgactttgaggtgaaggcggagctggacaatatctgggatctgccatacttaaaccgcacgattgcagaaaatattttagatgaagtgaaagtggagcttccgctgtctacgattgcggaagtgcgtaagaacggtacggcgggcgatgtctaccgcgtggaaggctatgtgaccgcaggaacagccgtggagggcaacaccttctttgatacgatctatatccaggacgacaccgcgggaattgatattttcccgtatgcggagagcggacttgccatcggaaccaaggtggagattaccggatatgtggacgcctaccagggcgataaagagcttaaggtgataagcagccggattctggacgaggagccgaaggtgattgcaccggagaaactgtcggcaaaagacgccatggactatgaaaagtccggcggtaagctggtacaggtggagggaacggtaacggatgtactctatgatgcggcgggcaccggcgtatcacagttctggctggatgacggcagcggcgtcaatgccaatattttcatcgacggatatatcttatcggcaacgacaggaaagaatgaactcgcatcggttgtgtcgacaggaaaacgcgtgtcggcggtcggcgtggtctatgcacatccggagggaacctcggacgaggcagtgacctgtctgcgtgtaagaaactgcgatgagatcgtggaagtgacgtccggggagatgccggatgacacggagacgccgggcaataccgagacaccggatacggagacaccgggagatacaggttcgtcagacagcggaactgacagcgcggacggaaatggaaatggaggaagtgtaagcggcagcgtgactgtatcggacggacagacgacagatgcggtgacggttgcttcgcagaatgactgggatccggtcagaaacagagtgacagcggcatccgccggcagcacagtcacggttctccttgcagacggtgtttctgtgccgggagatgtcattgcggcagtgcgcggaagggatgtacgtctggtatttaggctggcaaatggaatcgtgtggacgattgacggaagaaacgtgacatcggatacggttccggatatggactttggcgtgacgatcaacagccatgccgtgccggatgcgcttgcgagacagaccgcggcgggaagagattatttccagatcagcttaaaccatgacggcgcattcggttttaccgcagtgatgacgctgccggtgggaacacagtatgcgggcatgtatgcaaagttatattattacaatgaagcaaagggacggctggaactggcatcttccggaaaagtagatgcaaacggaaatgtggagcttacctttgtacatgcatccgattatgtggtggtgctggatcagatgcctgcagtgcagacgggggatgacactccgcttgcagtagcagtgatgatgcttcttgcaggtatggttctgcttgcagcggcagcacgcaaaaaaaggatatttttgaaataagggtggttaaaacatgaatttcaaaaagagcaagatacgcagcctggtgcttctggcactggctgccgttgctttttgcggactgatctggttcgcgaataaagacagaccggtttataggagcagcaacatggcggggacggactatgaggtcggaagagtcctgcgggttgtggaggatcacaagacggtggatgaggagatggacggaatctggcggggaagtatgacgctggaggtagagatccttaccggacgttacaagggcgacacggctattgtggaaaattatttcagctccctgtacaacgtcagggtggcggagggggataaaatctccatccgcatcgacacgacgggggaggacgaatatcaggtctcggtctacaattattaccgcgttccgcagatgattggctgcatcgtggcgtttgtgctgcttctcgtattgatcggagggaaaaaaggtgcaaaatctgtggcggggctggcgtttaccgtggtatgtatcctctggattttactgccgcttgcgctgaagggttactcgccgctggcggtcactatcctgctcattctggtctgcaattttgtcagtttcttcctgatagacggcatctcgaccaagacggttgtggcggcaatcggaagcatgctgggtgtgcttgcgggagcagtgtttgcactgatcgcgcagaatgccatgtcgattacgacttaccagatggatgaggcggagacactgcttctgatcacaagcaccacggaactgaagatccgggatctgtttttgtgcggtattctgatttcgtgtatgggagccgtgatggatgtggcgatgagtatctgttccgcggtggcggagatccatcaggtggatcggtcgcttggcatggcgaagctgtttgcctccgggatgaatatcggaagagacgcgatgggaaccatggcgaacacgctaatcctggcagtcgccgggacatcgctgaacatgatgttgatgatctactcctatgacgtcagctttcagcagctgatgaatacggactttgtggcgatcgagattatccagtgcattgcgggaagcgtgggtatcgtgtgtacggtcccgctggtagcactgctgtccgccgccgtatttggaaaaaagacaaaaaaatgagactgcactatggcaggatgacgatctgccgctgatattcggaggcggggggaacgtcatgctcctgcatgcgggcggcgcgcagaggcgtgccgcctttttgattgcgcatctgcagatagagattcccggcaaatacatcgtgctcaaacacctgcatggcatccggggacaaaagctttggcgcctgcgacggccgtgtgataagcggaactgcagcagaggcttttagtgcggcaagcaggggagcggcgcttttccgaaagccgagaatgcgtagatagggaattttatccagggcattgccgcatgcgtaatcggaagaagtaatgccaaggatggagtgcagcaaaatgcggttaatgcgcgtgagagtcatttctttgctttttaaccgtgacgcgaaggaggaaaaagaggtataataaggaagctggtttcgcatgcggttggcaaattccggggaggaatcggcggtccgggcgagttgtgaggcagaactgcttaacagcagataacccagaatgctggaaaagtcatcggcgcacagcagcggaaaatctgcccggtagtcctgcaggatggacagtgcctcctgcggcatggcatgatgcagaatcccgtcggcagaatcttcggatgctccggcgccaccggcgaagagtgtatgccggatcgcggatgcggaggccgggacttcggaggcgccggagcggatggatgtttcgtggtacgcggcgccttcccgctttagcagatagggcgtgatcgaagacgcgcggcggcgcagcgcttttaagtattccagagccagtatgttgttcggggaggcgagcagggaggagagcgcctctgcggatacgggcagggcgccatcctgaccggcggagccggaaaaatacgagagcagggcagcttcccttgcctttgggaatgtactgccggattttaggttgtgcttcagggaagcctttaaatccgccggttcatccgcgagaacgtccgcaatgcggcgaaggagggcaaggtcgccgctctcagcgccaaaacagatgccgtttacgcagcccgttttctcaaagagggagattccggcgtccgcgaaaagctctgcggaagcggtggaccagagtacgggaagctcgagcacgacatctgcacccgaggagagcgccatgcgggcacgggtgtatttgtccagaagggcgggctctccgcgctgtacatagtcgccgcttgtggcgacaacgatatagtcggcgtgaagattttttctgacatgcgcgatctgataggcgtgcccgttgtggaatgggttgtattctgcgataatgccaatgacgttcatggcggatcctcccgtactgcaatgtaataaaaactgtagctatcatagcatactgtgaaatagaaaaaaagaaaaaggagcatttcacgtgaagagaaacagaaacattggagcgattcttctgattgcggcaggacttttgctgattgcggcagccctttatgaactgatcccggcgctgctcgcgtacaagcgggcggacgatacctacgaggcgctgcgcgaggcttatgtgaccggacagccggggacatcttcggatgatccggcggaggagggagaggagctgccggcatggtatgaggcattgcaggtggattttgagacgctaaaggaagcaaatccggatgtgaccggctggatttattttgacaatatagagcagatcaattatcccactctgtattccggggatgacgagacctacctgcataccgatctctatggaaatgcgtcgaaatccggctgcatttttatggaggggaacaatgtccccgattttaacgactgccacacgattctgtacgggcacaacatgaaaaacggaagcatgttcggttcgctgaaacaatataaaaacgacggcttttatgaaaaaaatgcgtattttaccgtgtttacggaggatgcagcctaccgctaccagatttttgcgtacagtgatgtcccggaagattcggacgtctatacgaccgggtatctgccggatgagacttttgacgggttcctcacagagctgcttaagtcttcctacaaggatacgggcgttgcggtgggaaaggatgacaaggttctgacactgtccacctgctcgggtgacgggctgcggtttgtggtgcacgcggtgcgggttgacgaacacgaaagcggggtgtgactgttaaatttttgtcaggctgtttttcattttgtacaaagaaactggcaattactggcttgtttcgcgggcgtgacaagcgtatactaaaactatatgcggtctgtgagagacagacctttgcaaaacaaggaggcagatcctctcctcgccagagggctcggattttgcttcgcaaaacaaggaggatattatgaacgtattagttatcaactgtggaagctcttcattaaaatatcagctcatcgattctgagagcgaagcggtactggcaaaaggtctctgtgagagaatcggaatcgacggaagactggtataccagaagaccggactggacaaagagattacagaagctgcaatgccgacacacaagcaggcaatccagatggttttagatgcactggtgaatccgaagaccggcgcaatcgcaagtctctccgagattgatgctgtcggacatcgtgtcgtacacggtggagagaagttcgcagcatctacacttctgacaccggaagtattaaagacaatcgaggagtgcaacgatcttgcaccgcttcacaacccggcaaacctgatcggtatcgatgcctgcaaggagctgatgccgaacgtaccgatggttggcgtattcgataccgctttccatcagacaatgccgaagaaagcatatctctatggtctgcctcatgagtattatgagaaatacaaggtcagaagatacggtttccacggaacaagccacagctttgtatctaagcgtaccgcagagttccttggtatggatcttaaaaattccaagatcatcgtggcacatctcggcaacggcgcatccatcagtgccgtattaaacggcgagtgcgtagatacctccatgggtctgacaccgcttgagggacttgtcatgggaacacgttccggtgatattgatccggcgatcatggaattcatcgcaaagaaagagaatcttgatatcgaaggtatcatgaatgtattaaataagaagtccggcgtacagggaatgtccggtctctcctctgacttccgtgacctgcaggcaggacacgaggcaggcaacgagcttgcaaccaatgcgatcgaggtattcagctatcgtgtggcaaaatacatcggctcctatgtcgcagcaatgaacggcgtagatgccatcgcatttaccgcgggtatcggtgagaacgtgaacctggttcgtgagaaggtaatgtcttatctcggttatctcggcgtgacggtaaatcaggcagtgaacgatgcaacccacggcgacgaggcgatcatctctaccgcggattccaaggtaaaggtatgcgtgatcccgaccaacgaggagcttgcgattgcaagagagactgtagcgcttgtaaaatagtttttgctgtcaagggaaattccttgacaaaaaagcaaaaaagtgattgacaaaccagggacgcctatgtataattggttaggtgtgaaaacctcatatgtatgaggcgaaggagtaaaccatgcagattgatatttcagagattgtatcttgtgagaacagagaagttaccgagaaggttcatatcgagcaggatacgtttgtatcgaggcttggtgagttcccgatcacgaagagcgcgccgtttgatctcaggattgcgaaccgcgagggcagtgagctgcttttgagcggggagacggatcttacagtatcaatcccgtgcagcagatgtcttacggaagttccgacggacatccacattgtcatcgacaagaagctccgcatggacggaacggaagttgtggatgatgaaatggaagaaacagactacctgattggattaaatctggatatagataagcttatctatggagagattttggtgaactggccgatgaaagttctgtgcagagaagattgcaaaggaatttgcaaggtgtgcggaatgaacctgaataaggggaactgcgattgccagagaacagaactggatccaagaatggcagcaatccaagatgtctttaacaaatttaaggaggtgtaagtaaatgtctatttgtccgaagaataaatcttccaaaggaagaagagataaaagaagagcaaactggaaaatgactgctcctgcattagtaaaatgcagcaagtgtggagagctgatgatgcctcacagagtatgcaagaactgtggctcttacaacaaaaaagaaatcattccgcaggactaattccagcggtacagaggagatccggatctgccgggtctcttttttgtgtaataggaaactccgttcctattacacaaaaacgctccgcggggatgcacacctcgcggtgaggtaaataatgctttgcataccgcgagggcgcgcaagtgtgcggcaagcgcacacttggttctcatggaaactccgtatactctgttctggtattgaaaaaaagtgttaacaaattgttaaaaagtggttactttttttgttccagatatttacaatgatacatgtaacgtcacaacaacaaggaggaaatgttagtgaagaaggaattgaacgagacagaaacgaagcgctccgcaaagagaagcggaatggctcgcagaattacagcacttgttcttgcaggtgtgttgacattcggaggtacggcaaccgtatctgcagcaacattgagagatgtatttgatgcacagtattattctgagacctacagcgatctcaaggatgcattcggtacgaatcagacagcattgtacaagcattataagacatttggtaagagcgagggcagaacaagcacagcacttatcgacgtacagaaatacagagcagcatacccggatctggatgcggcattcggcgataactgggatgcatatgtgaatcactacatcaaatacggctttaatgagggaagaaattctttcggcacctttgatgcaagagcatacgcagacagatatccggacttaaaggcagcattcggttacgatgtgcttgcgctttacaagcattacttaaagttcggtagagcagagggaagagatgcgagcgcagctgtagtagcaacatccagctacacagagtcttcttacagcggatcttctaatacaggaagcgctgacaacggcaacaatacttctaccaacacagcaccgatcagaacaaacggtcgtctgacaaacccggagacaggtgcaccggttgcaggcgcaacagttacattcagactgacaagcttcaatgcaacagcagaggaagcagaagcagctacagagtctgttgagacaacggctgagacgacagagtccacagaaactacagagacaacagagtctacagaagctacagagacaacagagtctacagaagccacagagacaacagagtctacagaagctacagagacaacagagtctacggaggcaacagagtctacagaggagacagaggagccggagaatggtctggttgtaggcgatggttactatgagattaccacagacgcaaacggttactatgagattccggaattcgtaccgggtgtatactccgttcaggcagcagctgttggttacttaaccttgacagtgaactccatcagcatcaacgctgacaatggaagcttcacattgccaacattccagctgttgagctctgatatgagcggtgtgaataccgttgcaggcgttgcaaagaatgcaaccacaggtcttggtattgaaggtgtaaccgtaaatgtacgtgcgaactggaacaatcagtccggtgatgtgatcgctacgaccaccacagatgcagacggcaattacagcttctctcttgagagaggttactacacccttgagttcgcaagagacggattcgtatccacttttgtaaacgtagcaagctccaatgcaattggtgcatgcgaaggcgtattaagcccgaccagcacaagcgaggttaccagcacagaattcagaatcgttcttacctggggtgagacaccgagagatctcgattcccacctggttggattagatgatgccaactctgtattccacatcgcttactacaataaggtagagagagatacggacggtaacgtgatcgcatccctggatgtggatgatgtaagctcctacggaccggagacggtaaccatcgtaaatgcacgtacagatgctacttactattactctgtaaaagactttacagatcgttatgacgctacatccacaaagatgtctgagtctggcgcaaacgtaaaggtataccagggatctgttcttgtgaaagagtacaatgtacctctgaatcaggcaggtaccatctggaatgtatttaagattgagaacggaagcgttgttgacatcaacaactacaatgcagacgagaccacaatgtatggtgagtatgcatccgagtacaattactaaaatgattctttagggaaaaacagccgcggagacgcggctgttttttctttataggaaaacactttgtgctgcgccttttgttccttgaccggggcgttatggaaagctataataaatgaatatggtacaagagaaaaactggtggaaacggattgaagaagaaatgcgtagagtgcatagatgcaggatgaaggcagtgctgacgctttggggtatagggcttttactgggactgggaggctgtgcagaacagacacaggatgctgccggggaagagagcaggacaacggagcagataccgcagagcacggaacagatgccgcaagacagcggacagactggagcggaaacagaacaaatggcaccgggcagcgggcagaccgggacgggaacggaacaagcggtacagagcagtgaaggaaccggggtggagacggacggtgcggaagacactatggaagcggtgttggagcaggcattgccgtcggtggtacagatttatcacgggacgccggagggaggacataccgcgggttccggttttattatggaaatgacggaagatacggtgtatctgtgtacgaaccgccatgtcatagcaaagtacgacgactgggatgtgtatttttatgatggaacctgcgttacgggaagcaaagcgggtaccgacgatgtttatgatgtgggcgtcgtggcggttgaccggacggcgattccaaagaaagtgcaggaaaagctaaagacggtggcgtatgatcttgcgagttgggaagaacttggcaatgcagagttgccggtcggaatcgtgcgcatcggacaggaaggcaatgtgctccacatgctgacgggaagtcttcttcggaaagagacggaattcctgtggggacggggagagaaggagacggaagtgcgcatggcgattaccgacggggattccggatcggcggtttttgatgaaaacggaaagctggtcagcatgatattcggatgttcacaggacgccggaggcgagcgtgactggggcgtcccgcttcgggcgatcgtgtcatgttatgagaaaataacaggagaaacataggagacagaaagaaggattcatatgggtgatttttttaatttggataataagttttttcagggactcagtaaggtggttgactgtgtgatcctaagcgtgctgtgggtgttctgctgcatcccgatggcaacgacatttttcctggcatggcagagcgcatcagtattcggatggattctgtgctggctgacatcgtttctggcgggaccggcaacgacggcgctctattatgcggtcaataaggtaatccggcacggaagaagctatctgtggaaggaatactggcatgcgtttaagagcaactttaagcaggcggcgctcgcagcgctgattctgacaggagtggttctgtttctgggactggactgctatattatgtatcagtttgctgcgcagggacaaaagagcggcgtgctgtatgtggttttcctggtactgattgtgcttgtcgtgatgctggcggtatatctgtttgcctacatggcacgctttgagaacagtctggggcagtcgtttaagaacgcggcgctgattgcggtggcgaatcttccgtggtcgctgcttcttctggtgcttctggcagcgagcgcctttggcttgtggatgcttccgtggcttatgatactgcttccggcagtctacatcctggtggcgaattttatcctggagcgcattttccgcaagtatatgtcggcggaagatctggaggcggagcaggaacgaaatcaggaatttttcaattagaaataagcgtattttttattgttgatttatagaaagagttatagtatattcattagtaggcgtggagaactagactccggcaggacagatgggagatggagtatgcagcagagcagcggggctgtgaggacaagaatcgtattggatgcgatgggcggagactacgcaccggcggagccggtcaagggcgcagtggatgccgtgaacgcacggtcggatattcaggtgctcctggtaggacaggaggatgtcgttcgggaagaactggcaaagtatacgtaccccgaagatcagattcaggtggtacatgcagaagaggtgatagagactgcagagccgccggtgaatgcaatccgcaggaagaagcagtcatccattgtcattggaatgaatatggtaaagcagaaggaagcagacgcatttgtgtcagcgggaagttccggtgcgatcttagtcggcggacaggtgattgtcggccgcatcaaaggcattgagagaccgccgcttgcacctttgattccgacggagaagggagtctctcttctgattgactgtggagcgaatgtggatgcgagagcttcgcatctggtgcagtttgcgaagatgggttccatttatatggagaatgttctcggagtgaagaagccgagagtggcgattgtcaatatcggcgcagaggaggagaagggcaatgctcttgtgaaggagacatttcctctgctgaaggcgtgtgaagacatcaattttgtgggaagcattgaggcgagagagattccaaagggagaggcggacgtgattgtctgcgaggctttcgttggaaatgtcatcttaaagctgtacgaaggactcagcagtacgttaatcggtgccatcaagaaaggcatgatgagcacgttgaagagtaaaattggtgcagcacttgcattgccggcattaaagtctacgttaaagactttcgatgcaacacagtacggcggtgcaccgcttctgggactgaatggtcttgtggtcaagacgcacggaagtgcaaaagcaaaagagattacgaattctatttttcagtgtgtgacgttcaaagaagaggacatcaatggaaagatcaggaaaaatatagtaagttctgcggaacaggaaggaatgtaggttatggaatttgaaaagctgaaaaaaatcattgcagaggttttgaatgtggatgaagaggagatcacgatggagaccacattcgtagatgatctcggagcagattccctcgatatttttcagatcattatggggattgaagaggaatttgacattgagattgcaaatgaagacgcagaacatattgtgaccgtatcagatgcagtagaagagatcaagaatgctttaaactcataagagacaatttgatgatgtgtcataaagcccttgtccggaaagcaagggcttttgttgataagaggaacccgcatggcggcgttgccgcggggcacagagattttgaggctttttcttactctatacaaaggctgtagggcaagaaaagacctccgaaagagacgaggaggataatgaaatgtcaaaactgacagaactggaacaagtgattggttatgagtttaacgagcagagactgttgcagcaggcgctgacacacagttcctttgcgaatgagaagcacatgaagaagctttcggataatgagaggctggagtttttgggagacgcggtcttagaggtcgtgtcgagtgagttcctctacaaggagcatacagatctcccggagggcgatctgacaaagctgcgcgcgagcatcgtctgtgagccgacgcttgcgctgtgcaccagggagattgaccttggaaagtatctgtatctgggcaagggggagaatctgaccggcggaagaggacgcaagtcgattctttcggatgcgctggaagccgtgatcggtgcgatctatctggacggcggttttgagccggcaaaagcttttatccaccgcttcattctgacggatattgaacacaagaagctgttctatgacagcaagacaattctgcaggaagtggtacaggggcattacgaggaaccgcttcactatgaactcatcggcgaggagggaccggatcacgacaaacgtttcctggtggaggcggtgatcgggaatacgacaatcggcgagggaagcggacataccaagaaggcagcggagcaggaggcggcatatcaggcattgctctggatgaaagagagaggtttatatgtatcttaagagcattgaagtgcagggattcaaatcatttgcgaacaagatcgtatttgattttcataacggaattacgggaattgtcggaccgaacggcagtggaaaaagtaatgtcgcggacgctgtgcgctgggtgctcggagagcagagtgccaagcagcttcgcggcgccagcatgcaggacgtcatcttcgcgggtacggagaaccgcaagccgttaagttatgcctatgtggcgattaccatggacaattcggatcatcagcttgccattgattttgaggaagtcaccgtggccagacgtgtgtaccgctccggcgagagcgagtatctgatcaacggaagtccgtgcagactcaaggatgtgacggagcttttttacgacaccggtatcggcaaggaggggtactccatcatcggacagggacagatcgagcgcatcttaagcggtaagccggaggagcgcagagagctgttcgacgaggcggccggcattgtaaaatataaaaagcgcaaggcgacagcacagaaaaagctggagaatgagcgcgagaatctggttcgtgtgaatgatattttagccgagctggagcgccaggtcgggccgttggagcgtcaggcggagaaagcccgcatctacctgaagaaaaaagaagaattaaaagaatatgatgtgaatatgttccttctggaagtggagcgcattgaggcgcagcttaaggaagtggaaggaaaatatcacatcgcggacgaggaatcgaaggaagccagccagtcttacgagaatatcaagagtgaatacgagaagctggaacaggacatggcttccatggatgacaagattgcatccattcgtgaggagatgagccagtccaccgtgaccaagggaaagctggaaggacagatcaatgtcttaaatgagcagatccacacggcggagatgaccgatgagcatttaaagagccgtctggactcgatcgatcgggaaaagcaggagcgcatcgagtcgcgcggtacatacgaagcggaaaagcaggaactcgacacagagcttgcagctgcggcgacggaaaaggagacggcggcagagcagctgcggaacattcaggaggagatcgcgcgctgcaccgagggcattgaaaagggcaagaatgagattatcgaactgttgaaccgcaaggcatccgtcaaggcgagacagcagcgctacgacacgatgatggagcaggtgaacatccgcaaggcgcagctgacgcagcgtctgcttgcgcgcaagaccgaggaggcggatcttatctccgttctggaaagctatcagaaggagctcgatgcggtgaacgcgtcgatcgcagaactgaagaaaaacgctgccgggatggatgagcagaaccgggagtggaagcgcaagtccctggaagccaatcagaagctggagagcgcggttgcacagtaccataagcagcagtcccgtctggagtctttgaaaaatattgcggagcgctatgacggctacggcaacagcatccgccgcgtcatggagcagaagagccgcaacgcgggaatccttggtgttgtttccgatctgatccaggtggacaaaaagtacgagacggcgattgagacagcgcttggcggaaatatccagaacatcgtgaccgaggacgaggagacggcaaaacagatgatctcctacttaaagcagaaccggtacggacgggcgacgtttctgccgctgacgagtgtggacggcaagggcaactttaaaaacacggatgccttaaaggagccgggagtcatcggtcttgccaataccctcgtgaagacggaggaaaaatatgctggagtgaccgcttatctgcttggcagagtgatcgtgacggagaatatcgactatgcgatcaagctggcgaaaaagaaccgctactcgttacatattgtgacgctggagggagaatatttaagcccgggcggttcaatgacaggtggagcgtttaagaacagcagcaatctgctcgcaagaaaccgcgagattgaagaactcgagaagaacgtaaaagatctggataaacagattgcagagcttaaaaaccgtctggaggacatcaagacggcgcagagcctgcttgcggaggacgtcgagagcaataaggcgagcctgcaggaggcgtacattgcgcagaataccgcgaagatgaacgtggagcgcgcgatggagcagaagaacgagagcgagaacgtgtttgcaggcttacagatggagaaccgtgagattgagagccagctccgtgagattgcggagaacaaggacaagattgcagaggaactgcagtcggcaaaggagcgggaggcacagatcgaggaggagagcgccggattccagaagattctggatgaaaatgcgggcagagaggaagaagcccagaaggcagtatccgatgtacagttaaaggaagctgccgtgcgccagaagttagagttcgttctgcagaatctggagcgtgtgaatggagagataagacgttacgaggaagagcgcgagggattcgtcacggaggcgaaggaagcgaaggcggatgcggagaagaagcgccacgatattgaggagatcaaaaagacgatcctggcgtcaaaggacaattccgagcagctggagcaggcactgaaggagcacacggcgcgcagggaagaaatgtcctcggaatacaagggatttttccagaagcgcgaagacatctccaagaaaatctccgatctggacaaggagattttccgtctgaacagccagcgtgaaaagctggaggaggcgcacgagtatcagaacaattacatgtgggaggagtatgagctgaccctgcatgcagcgatggagctccgcaacgaggaatacacggatcttgcggcgatgaagaagatgatcgcgtccatcaaggacgagatccgcaagctgggcgatgtcaatgtcaacgcgatcgaggattacaaggagatctcggagcgctacggatttttgaagacccagcatgacgatctggtcgaggcggagaagacgctggtcggcattattgaggaactcgataccggcatgcgcaagcagttcctggagaagttcgcggagatccagaccgagtttgacaaggtattcaaggagctgttcggcggtggaaaaggaacgctcgaactggtcgaggacgaggatattctggagtgcggcatccgcattatcgcgcagccaccgggaaagaagctgcagaatatgatgcagatgtccggtggagaaaagtccctgacggcgatttcactgttgttcgccatccagaacttaaagccgtccccgttctgtctgctcgacgagatcgaggcggcgctcgacgattccaacgtcggacgttttgcaaagtatttacataagctgacgaagagcacgcagttcattgtgatcacgcacaggcgcggcacgatggcggcggcagaccgtctgtatggtattaccatgcaggaaaagggtgtatccaccctggtatccgtgaatctgatcgagggcgatctcgacaaatagcaggaggaatgagtacattatgggcgaggaaaagaaaggcttctggggacgtctggtcgagggcctcagcaagacgagagataatatcgtatccggcatagattccattttcagtggattttccagcattgacgatgatttctatgaggagatcgaggagattctgattatgggagacatcggcgtcaatgcgactgagtcgatcattgagagtctcaaggaaaaagtgaaggagaatcacatcaaagatccggcagagtgcaaggaacttctgattaacagcatcaaggagcagatggatgtcggcgagacggcataccgctttgagacggagaaatccgtggttctcgtgatcggtgtcaacggcgtgggcaagaccacatccgttggaaagctggcgggaaagctcaaggaccaggggaaaaaggtcgtgcttgcggcagcggataccttccgcgcagcggcgggagaccagctgcaggagtgggcaaaccgcgccggtgtggatatgatcggcggacaggagggcgcagacccggcggcgatcgtctacgatgcggtggcggcagccaaggcgagaaatgcggatgttctgctgtgtgatacggcgggacgccttcataataagaagaacctcatggaggaattaaaaaagatcaatcgtattctggaaaaagaatatgcggatgcgtaccgtgagacactcgtggtgctcgatgcgacgaccggacagaatgcgttaaaccaggcgagagagttttccgagtgcgccgacatcacgggaattattttaacaaagatggacggcacggcaaagggcggtatcgcagtggcaatccactcggagcttggcattccggtcaagtatatcggcgtcggggagacgatcgaggatctgcagaagtttgattccaaccagttcgtaaacgcattatttgaagtaggagaggagaaaagcggatgttgacattagacaagttcgaggaagcaagtgaaaaagtcaaagaagtgacacttgagacaaagctggtatacagcgattactggagtcagcagaccggcaacaaggtttaccttaagccggaaaacatgcagttcaccggggcatacaaggtgagaggcgcatattataagatcagcacgttaagtgatgaggagcgtgcaaaggggctgatcacggcatcggcgggaaaccacgcgcagggtgtggcatacgcagcaaaatgctacggctgcaaggcagtcatcgtcatgccgaccaccacaccgctcatcaaggtgaaccgtaccaagagttacggcgcagaagtcgtgctctacggagacgtctatgacgaggcgtgccagaaggcatatgagcttgcggacaaggagggatataccttcatccatccgttcgatgatctggcagtggcaaccggacagggaacgatcgccatggagatctttaaggagcttccgctggtggagtacattctggttccgatcggcgggggcggactggcaaccggtgtgtccacactggcgaagcttctgaatccgaagatcaaagtcatcggcgtggagccggcgggagcgaactgtatgcaggcttccttcgcggcaggaaaagtaacgacgctgccgcaggtcaacaccattgcggacggcacggcggtcaagacgccgggaagcaagattttcccgtatatccagaaaaatctggatgacatcatcacggtggaggatgatgaactcgtcgtggccttcctggatatggtggagaatcacaagatgattgtggaaaactccggtctgctgaccgtagctgcgttgaaacatctggatgtttccgacaaacgagtggtatcgatcttaagcggcggcaacatggacgtcatcacgatgtcctccgtggtacagcagggactcattttccgcgaccgtatcttcaccgtgtcggtacttctgccggataagccgggagaactgtccaaggtttcggcagcgattgccgcagagcagggcaacgtcatcaaactggagcacaaccagtttgtgacaacgaaccgcagcgcggcagtggaactccgtattacgctcgagagctttggcaccgagcacaaaaaacagatcatgaaagcgctggagaagaaaggttataagccgaagctggtgcgcacgagtctgtaaacaaagaggaggagaaagaaaatgttagaaaagtggtttaaactgaaggaaaacaacacgacagccaagaccgaagtcatggcaggtatcacaacctttatgacgatggcgtacattctggcagtcaacccgaccatgcttgcagcggcgggaatggataagacagcagtgctcattgcaaccgcgctggcatcatttattggtaccatggcgatggcgctccttgcaaattatccgtttgcactggcaccggggatgggactgaatgcgtattttgcatacacggtctgcggtgcgatgggatattcctggcaggtagctttaatggctgtttttgtggaaggtctggttttcatcgtactttctttgaccaatgtgcgtgaagcaatctttaatgcgatcccgctgaacctgaaaaaaggtgtgagcgtcggcatcgggctgtttatcgcatttatcggtctgcagaatggcggcatcgtagtggcgaacagctccacacttgtttcctatgttgactttaccagcaatttcaagactgccggcatctgtgctttgttagcgctgatcggtctgtttgtgattgcaattatgtacattaagaacgtaaaaggcgcgattttattcggtatcgttattacctgggtgcttggaatgatctgtcaggcggcaggaatctatgttccggatgcggaagccggtttttattccttatacccggcgctcggatttaccgacctgaccgcgatcggtcagacattcggacagtgcttcaaactggatttctccaatgtgcgtgtctttgacttcatcgcagttgtatgtgcatttttgtttgtagatatgtttgatacactcggaacgttaatcggtgtggcaaataaagcggatatgttggacaaggacggcaagctgccgcgcatcaaggaagcgctgctggcggatgcggttgcaaccaccgcaggcgctgtgctcggtacctccacaaccaccacgtttgttgagagttcctccggtgtggcagcaggagcaagaacaggtctctcctctgtagtgaccggattcttattcctgatctctgtggtactgtccccgattttctgctcgatcccgagctttgcgacagcaccggctctgatcttcgtcggcttccttatggtgtctacggtgacaagcatcgagttcacggatatgacagaggcaattccggcatacttatgcctgcttgcaatgccgctcatgtacagcatctccgagggtattgcgatcggcgttatctcttatgtcatcatcaatgtcgtatgcggtaaggcaaagaagatcacaccgctgatgtatgtgctggcggtactgtttgtgtgcaaatacatcttcttataaaatgaaaaccgaaggtatggaggtatccctatgcgcagatggataaaacagatcatggtttggcttgttgcggcagcgtgcggttttgctgcggcgcttgtgatctgcagatggagcggtactgccttcggtcttttcatgtggccggtcattgccgcgggagcagggttcgtggtggccggcgtgggatttttttcaacagaaggaaagagtgagattctctacggaatctgtgcggcggcatgcctgttctgcatgatcgtgcagacggcgatggcggtgtaaaaagaaggaaaaagtgtgtcaagaaaaaatacttgacacctttttccttttatgctattctatcacggtggcaatgagtgagagatgccggatacggcgtgattgtgggatttcagatggaagagaagattgaacaggcgtatctgtatgatttttacggagaactgctgaacgaacatcagagaagaatttatgaggatttcgtgttcaatgatctgtctctcggagagatcgcggacgaggaaggtatcagcagacagggcgttcacgatatggtgaagcggtgtacgaagacccttgaggggtatgaggagaagcttcatctgatcgcaaagttcatgtcggcgaagcgcagcgtggaacagattcatgcattgacgaagcagtttcatgagagccatgacgaggcagtgatcgtggagattgaacagatttccaatcagatattagaggagttatagatggcatttgacagcttatctgaaaaacttcaaaatgtattcaagaacctgcgcagcaagggacggctgacggaagcggatgtcaagacagcgcttaaggaagtcaagatggcgctcttagaggcggatgtcaacttcaaggtcgtcaagcagttcgtcaaggacgtggaggagcgtgccgtcggacaggacgtgatgaacggactgaacccggggcagatggtcatcaagattgtaaacgaagagatggtcaagctgatgggctcggagacagccgagatcacactgcagcccggcaaggcagttaccgtcatcatgatgaccggtcttcagggagcaggtaagacgaccacagcagcaaagcttgccggaaagttcaagcagaaaggcaagaaggtacttctcgtggcaggcgatgtctatcggccggcagcgatcgaacagttacagatcaacggacagaagcagggcgtggaagtattttccatgggcgataagaacagcccggtgaacattgcaaaagcggcgatggaacatgccgcgaagaacgattttaacatcgttatcatcgatactgccggacgtcttcacatcgatgaagatatgatggcagagttgattcagataaaagaaaatgtcacagtgcatcagaccgtccttgtggtggacgccatgacaggacaggatgcggtgaatgtggcgaagacctttgatgagcgcatcggtatcgacggagtcattctgacaaagctcgacggtgataccagaggcggtgcggcgctttccatccgggcagtgaccggtaagccgattttttatgcgggtatgggagagaagctttcggatctggagcagttttacccggatcgcatggcatcgcgtattctcggtatgggcgatgtgctgaccctcatcgaaaaagcccaggaggactttgacgaggagcgggcgaagaagattgagcagaagatgcgcaagaacgaatttgactttgagatgtatctggagtcgatgagtcagatgaagaagatgggcggtctgtccagtatcctcggtatgatgccgggactcgggatgggcgcaggcaagatgccggatattgacgaggcagcagccgagaagagcttatcgcgcacggaggcgatcatctattccatgacgccggaggagagacagaatccttcccttttgaatccgagcaggaagcgccgtattgcggtgggagccggtgtcgatattgcggaggtcaaccgtctggtgaagcagtttgaacagatgaagaagatgatgaagcagatgcctggcatgatgaagaagggcagacgcggtggtggaatgttcggcaagcttccgttttaatgttagaaattgcgtataacgcattctaaatagatcagttaagcaaatttaaggaggtgaaagtaatggcagtaaagatcagattaagaagaatgggacagaagaaagctcctttctatagaatcgtagtagcagattccagatccccgagagatggcaagtgcatcgaggagatcggaacatacgatccaacgaaagatccaagcgagtatcatgtaaatgaggagttagcaaagaagtggttagctaacggagctcagccgaccgatacagttgctcgtattttcaagagcgcaggcatcgagaaataggattcgcgaggtggacctaatgaaagaattagtagaagtaattgcgaaatcactcgtcgattatccggatcaggtcgtcgtaacagagacagagaatgagaaagccatcgtgcttgaactgcgcgttgcgcagtccgacatgggcaaggtaatcggcaaacagggacgcattgccaaggcaatccgttctgttgtgaaggctgctgcctcaaaggaagagaagaaagttattgtagagatcatgcagtaacaggtcagaggagctgtcgcgccagataatggggtggcagctcctttgttcatattgcggctactgcggatatcagagacagaaacggaggacatgcatggaagatttattgcaggtcggtgtcatcacgacgacacacggggtgcgtggggaggtcaaggtatttccgacaacggacgatccagcgcgcttcaaaaaactcaaaaatgtgattttggataccggaaaagaaaaattagaacttgagattgcaggcgtcaagttctttaaaaatatggtgattctcaaatttaagggaattgatgatatcaatgatgtggaaaaatatcgcaaaaagagcctttatgtgacgagagagaacgcggtaaagctgaaaaaggacgaatactttattgcagatctgatcggcatgaaggtgtcgacggacgagggtgaggaattgggaacgctgtcggatgtgatgcagaccggcgcgaacgatgtctatgtgatctccatgacagacggggaggaagtgctcattccggcgatcagggactgcatccgcgatgtggacgtagagcagggacagatgtgcgtgcatctgcttccgggactgcttgacatcaaccgaaaataggaggcacagcatgaattatcatattctgacactgtttccggagatggtgacgcagggactctcggagagcatccttggacgtgcggcaaaaaagggactgctgtccgtgaatgcagtcaacatccgggattatacggcggatcgacataaaaaagttgacgattatccttacggcgggggagccggcatgctgatgcaggcgcagccggtctacgatgcgtggaaggcagcctgcgaggaaatcaggagccggcagccggaggagctgcgggacagaccggtgcgcacggtgtatgtgacgccgcagggagccgtgttcaaccagcagatggcaaaggagttcgcgaaggaggaagatcttattttcctgtgcgggcactatgaggggatcgacgagcgtgtattagaggagaccgtcacggactacgtgtcgatcggcgattatgtgctgaccggcggggaacttccggcgatggtgatgatagacgcgatctcacggatggtgcccggggtactggcgaacggagagtccggggagacggagtccttcgagggcgatctgttagagtatccacagtacagccgcccggaggaatggcacggaaagcaggtgccaaaggtgctgctgtcgggcaatcagagaaaaattgccgagtggcgcagacaggaggcggagcgccgcacacaggagaggcggccggatctctacgcaggctacgagagactgatgtcctgcaaaaaggtgcttgccggggacaagctgctgcatgtggatatgaccgagctgattgcgcgcgggcaggcgcgccttgtttttgcagaagggaaaaatatctgtctgcaggataaagtcagtggggcgtattttcatacggcggaggacatcaaagccggctgcaggatgcttgaaattctacacggggacgccggggaggagagcggccttctggtgctgcatcaggagttcatgacggaaccggcagaaaaatatctgggatttcgcacggcgatgacctgcaaccagatcgtgtatacaaagcacgaaaagctgcctgtcaccggactgtaccgcatggacggcaaaccggctgaaaacggcgtggtcatccgtccgcttacgatggaacacttagacgcggtggtgcgcgattacaatacgatatcggatgaggcgtatgtgacagaccggatcaaaaaaggagcgctcttcggtgcgtttgtggacgggcagcttgcgggctttatcggaatgcacgcggagggcggcatcgggatgctcttcgtctcgccggagtaccgcagacgccggatcggcatggcacttgagacatatatgatcaatctcggattagagcgcggtgagagaccctacggtcaggttgagatcggcaatgatgcatccaaaggactgcaggaggccctgggactctgtttttctaagggacgcatctactggatggagcgtgaagagagagaatgaaaatatttgccgaaaatgcttgcaatccgtacaatctgtgttatactggaatagttgtgaataaatagatggtcctctgttacgaattgacgtattaagaacatccaatgaatcaggaggtcacaaaatgaacgcaagtgaaatcattaagagcattgaagcagagcagctcaaggcagaagtaccgcagtttaacgtaggtgatacggtaaaggtttacggtaagatcaaagagggtaaccgtgagcgtatccaggtattcgagggaactgttttaaagagacagggcggaagcaaccgcgagactttcacagtcagaaagatctctaacggtgtcggcgtagagaagacctggccgttacattctccgaacgttgagaaggtagaggttgttcgtcagggtaaagtcagacgtgcaaagttattctacttaagagaccgtgtcggcaagaaggcaaaggtaaaagagcttgtaaaataatacaatgcagcgctaagaagccgggacatattttgtatggaacaggattccatatggagtgtgttccggtttttttcgtattataaggcaccaaaattaaattgcgaagccacagggtttgtgttaaagtaaagcaggaatcgtgtgcggcgggcacacggcacatggaggataagaatgcgcagacgtagaagcggactgaactttggcagacagaagaaaaaagtgaatatgtcggttgtgaaggaagcgtgtgtgtggatcattgagatcgcgatcacactgctggtagcgtttacactggtatattttgtcggactgcggacgagtgtcgtggggcagtccatggcggagacgctaaacggcggggatgagattctggtcaaccgttttatatacaaagtaaccgatcccaggccgaacgatgtgattgtatttttaccgaacggcaatgaaaagtcacattattacatcaagcgcgtcatagcggtgccgggggatacgcttcagattaagaacggcgaagtgtatgtcaacggcgaactgtttgcggaagatgtggatgtggcgcagatggaggatgccggactggcggcggaagagatcacgctgggtgaggacgagtatttcgtgctcggcgacaaccgcaataacagcgaggacagccgctatgccaacatcggcaacattaagaaggaatatattatcggaaaagtctggttccgcgtggcaccgtttaaggactttggatttttataaaacagacagtaagagaatggagagtaattatgcagtttcagtggtacccggggcatatgacgaaggcaaagcgtcagatgcaggaagacattaagttaatcgatctggtcatcgagcttgtcgatgcgcggattccgctcagcagccggaatccggacattgacgaactgggcagaaacaaagcgcggctgatccttatgaacaagtcggatcttgcggacgaggaagcgggaaagctgtggagtgcgtattttcagaagaagggctattatgtggtaagcctggattcgagaaacagaaacggcatgaagcaggtgacggcggtcgtcatggaggcgtgcaaggagaaaatcgagcgcgacagaaagcgcggcatcatgaaccgtccggtgcgggcgatggtcgttggaatcccgaacgtggggaaatccacgtttatcaattcctacgccggaaaggcgtgcgccaagaccggcaacaagccaggcgttacaaagggcaagcagtggatccggctgaacaagaatgtagaacttctggatacaccgggaatcttatggccgaagtttgaagaccagacggtcggattaaaactggcgttaatcggtgccatcaaggatgagattttaaacatcgatgagctgtccctggaattgatcaaagtgctgaccgcctactatccgggagcgcttcaggcgcgctatggaacggaggagctggatatcgacgagacggcggcgccggcagagatcctgcgtgggattgcggagaaccgccgctgtgtggcgaagggcggcgagattgactacagcaaggcggcgacgcttctgattgatgaattccgcagcggaaagcttggcaggatcacactggagcggcccgattagcacaggcagcgggaacatacggcgggagaggaagcagatggagacgaaaaagatcggagaaatcagggaagaattcaaggcggcagaggagaacatgctgccttcttttatcgaaaaatacaggtcggacgagcgcgcgggcgtacaaaagctcatcgagcaggcgaacggacgcctcgcaaagctggaggcggagcgtgcaaggattgaccggctgtggaggtatgagcgcgagtacgggatgtatacgcgtatctgtgggattgatgaggtggggagaggtccgcttgccggccccgttgtggcgggagcggtcattctgccgaaggactgcgacatcctctatatcaacgattccaagaagctctcagcggcaaagcgagaggaactgtacgatgtgattatggaaaaagcggtggcggtcggcatcggcatggtgggaccggagcgcattgatgagattaacattttgcaggcaacgtacgaggcgatgcgggaagctataagcaaattgggcgatgcacccgatatattattaaatgatgcggtggcgatacccggggttgcgatacggcaggtgccaatcatcaagggagatgccaagagcatctcgatcggcgcagccagcattgtggcaaaagtgaccagggaccggctgatggtggagtacgacaagatcatgccggggtacggattcgccgcgaataagggttatggctcggcggaacatattgcggcgctgaaaaaatacggtccgacgtcgattcatcgccggagctttattggaaattttgtagaggtttagacgggaagagggaacatacatgcagatatcggatctggtaggacagtacagccggaatgtggccaacggaacggaagaattgcatggggcgcagagcgttcagaaactggtgtcgacgatcggggatctctccgcgggaagtattttcgaggggacgatcaacagtgtgcgcggcggaaaagtgacgctggcgctgggcaatggacagaccatcaccgcgcggctggacggaaaaatggatttacagcagggctcgagcatgtttttccaggtgcgcgccaatgacgggcagacgattgcgatccgcccgtacaccgagcttggaaatgtcagcaatccgattctgctcaacgcgctttcggcggcgcaggtgcctgcgacggaccggacgcttgtgatggtggatacgatgatgcaggagcagatgtcgatcgacagacagagcattctcgatatggcgaagctggttggcgcgaatccggatgccaatgtgcagaccatcgtgcagatgacgaagctcggactcccggtgacggaggagatggcggcgcagtttgaaaattatctgtccgaccggcaggcactcgtgggagagatggatctggcagcgggacatatgatggaactgctttcggacgaggcgctctcgccggagacggcgttttctctctatgagaaaatgctcgatatttttatgcccggggcggaagcggcagatgccggagtgaccgcggcagcgggacaggaatcttccgcagcagaggcaggcgccggagtaatcgcggaagcagtgggacaggaaaatgcagccacggtggcagaagcagaggcgggcgcgcccacggcggcggaacagggaaccgcagcggcatcggcagtggcggagaaggcaggtgccgcttcgaccacggagacagcgggacagggcgcagcggcagaagcagagacaggggtcggagtgaccgcggaactgacatatggaaggacggcagagactccggggacagtcggggaactgttgtcgaaggagcagatcgagcatctgggaaaaatgcttcggaacattccggctctgattggcaacgaggagatttttgccggcggagagcaggaggaagtctttgtggatacgctctcggaagaaggtccggaggtggcgaaactgatggcgcaggaggaagcggcgcaggagcagccggtcttgaatgaaaaattgacggcagaacagtttttacagaagctcggcagagcgctcgcacagaatggcgggttcggctttgcgggaatgcagaagctttttgccggaaaggaatttcagaccattttccgcagtgtgatcgagaagcagtggcttctgcagccggaggaattaaagcaggagcataaggtgagcgggctgtatgagcgcttagagcagcagctttcccagatggaggaggcggttcgggcgaccggaagcacgcagaatacgtttttgcagacggcatcgcaggttcacggcaatctggagttcatgaatcagatgaaccagatttatcactatgtgcagctgccgttaaagatgtccggacaaaatgcgaacggggaactctatgtctatgcgaaccggaagaatctgcgcgatccggatgcggaactgacggcatttttacatctggacatggagcagctcggctccacggacgtctcagtgcggatgcagaaccgcagcgtacgcaccaatttttatctggaggatgatgcctcctatgatctggtggaaaagcacctggaagtgctgaacaagcgtcttaagagcaagggctaccagtcttccatcacggtcacacatgagaaaaaagacatcagtttcaaggagaacatcgtaaagaaaggaaaggcgacggtgggaagcctgcaccgctattcttttgatgtaagagcataggaaagcaggattctttgaagggaggatgtggcgatggcggagaacaagcatattgcaggaaaagaaaagacggcggtcgccgttgcctacaatccgggcgaggtggcgccgaagatcctcgcagtcggaaaaggcgaggtggcggagcgcatcattgagacggcaaaagaaaacgatgttccgttttatcaggataacaagctggcggagaccttatccagacttcagatcggggatacgattccgccggaactctacgaggtggtcgcggagatccttgtctttgtggacgatatggaccgcatgaagggaaaactcaaagaatccggcttactgtaggcagatgacagatgccgtgatggtaacagaaggcacgggaagaacccggacggcggaacgtggtgatggatcggacgaaaggcagggagagaggataccggatgaacaggcggcagacgggaacagcgtatgagagacgggcgggggagtatctgaaggaacagggatacgagctgattggatacaatttcagatgccggcagggagagatcgacatcatcgcccgcgatggcagatacctggtgtttgtggaagtgaaataccgcagagacgggcagacgggcgatccgctggaggcggtggaccgggcgaagcagcgccgcatcagcagaacggcgcaatattactgcctgacgcacggatatggggagacgacgccctgccgctttgatgtggcggcggtgcttggaacggacggggaagtacggcttgtgaaacatgcatttgaatttcagggatgacgggaggatgagacttgacagcgtttgtgagaaaaccagcagaacaaccggttttgcgggaggactggcatgaaaatgaggacggcagcaggcttctgctgctaaaatatccccttttggagcgcacggggatcgtggagcattgttttacaacacggctcggaggtgtcagcacagacattttttctacgatgaatttaagctttaccagaggtgatgaggaggcggcggtgcgtgaaaattaccggcgcctggcgagggcactcggggcagaggtggggcagtttgtctgctcggatcagacacataccgtcaatgtgcgccgcgtcacggcagcggacgccggaaaaggactgaccagagagcgggactaccgggatgtggacggactgattacggatgagccgggacttgtcctgtcgacgttctacgcggactgtgtgccgttatatgtggtggatcccgtacaccgcgccatcggaatgagccattccggatggagaggcacggcggcgcgcatgggagcggtcactctgtctgccatgcaggaggcatacggcaccagaccagaggatgtggtctgcgcggtcggtccgtccatttgcaaggactgctatgaggtgagcgcagatgtggcagatattttcgcggaggaatttccggggcatgagcaggagattctggcagagagtgagaagaacagcgtcgggatggctcacgcagacaaaaaataccagctggatctctggaaggcgaacgagatcatttttcaggaggcgggcgtgcgaaaagagcatctggcagtgacggacatctgtacctgctgcaatccaaagctgttgttttcccaccgcgcaagtcatggaaagcgcggaaatctgggcggatttctgtacctgaaataaggatgtataagatcgtccttcaggtatggtctgtagatagaatcaaatagaaagcggaaaaggagaaaaaagatgaagacaaaaaaatatgtggaatatatggtcgaggagacaaagaagattctggcaatcgacagtccgagcggatacactgcagaggtggcggattatgtgatgaaagagtaccagaagctcggctatgagccgaaactgaccacgaaaggcggcgtgcttgtggcgcttggcggcaaggacaaaaagaatgccgtgatgctcgaggcacacattgacacgctcggcgccatggtagcggagataaagtccaacggcagactgcgcgtgacaccggtcggcggaatgaacgccaacaatgccgaggcggagaactgcagaatccatacccgcttcggggaaaaggtctacgagggaaccctgcagcttgccaatgcatccatccatgtcaacggcgattacaatgacaagaagcgtacatttgacgagacggagatcgtgctggacgagaaggtacattccagagaggacgtggaggcactcggcatcatgacgggagacatcgtctgctttgatccgcgcacgaccgtcacagagagcggctacatcaagagccgtttcctggacgataagcttagcgtcggcatcctgcttggctatgcgagatatttaaaggaagagaatgtcacaccggagcgcatgatctaccagcacatcaccgtctttgaggaagtcggacacggcggagccgcttcgattccggagggtgtgactgaggttatttccgttgacatgggctgcgttggagacggtcttgcctgcgaggagacacaggtgtccatctgcgcgaaggacagccacggaccgtatcactacgacgtcgtgacgggactgattgcggcggcaaagcgcgaggaacttgactttgcggtggacgtctacccgcattacggatcggatgcggatgtggcgctgacggcgggctatgacgtgcgccacggactgatcggcgcgggcgtgtacgcgtcgcacggctacgagagaagccatgtggacggcgtgaagaacaccttcaaactcctgtgtgcatatctgggctgatgccgaagttaaataaaagttaataatttcataggattatctttattgtatgagggaaccttccatgctatagtagctgtattaagacaaatagtacagttggtacagatgggaggttatgatttgattcagttaaattaccgggactccaaaccgatttatgaacagatcaaggatggctttcggaagctgattatcacaaattctctttcggcaaacgagaagctgccgtctgtccgcgaactggcgtccggactggcgatcaatcccaatacgattcagaaagcgtatcgcgatctggagagcgagggatatacatacacggttgccgggaagggaacgtttgtggcggagcacagggaaatcctgaatacgagacagcatgaactgctggaagagttcgatgaagtggtggaggagctctgtttcctgtcagtgagcaggagcgatctgatcacacggatcgaacatgcggcagagggaggagagaaggtatgattcaggtaaacggattaaaaaaggcatttgacggatttgtggcgctaaacggtgtggacatgcacgtggaaaagggagccatctacggtctggtcggaccgaacggagcaggaaagtccacactcatccgccacctgacgggggtgtaccgtccggatcagggagaggtgcagatcgacggggaaaatgtatatgagaataaggcggtcaaatcaaaaatcgcgtacataccagacgaactgttttatttcatgcaggcagacacgatggagatgaagcgtttttatgaggggatctatccgtcttttgatggaaagctgttttaccggatgcaggagtttttcccgaatattgatgtgaagcgcaatatcagacggctgtcgaaaggaatgcagaaacaggtggcattctggcttgccatctgctgcaagccggatattctgattctggacgaaccggtggacggactcgaccctgtgatgcggcgtcagatctggagcatcatattgtcggaggtcgcagagaaagagatgaccgtgcttgtatcgtcccacaatctgcgtgaacttgaggatgtgtgtgaccatgtcggtatcatgcatcatggaaaaatcatgatcgagcgctcactgagcgacctgcagggaagtgtgtcgaaaatccaggtggcgtgtcagagcggaatgccgaagcttccggaacattttcaggtgcttcacatggcaaatacagggcgtgtgtataccatgatcgtaaagggagatccaaaggaagcagaggcggcactgtcatattgcaatccgacgattgtggatgtactgccgctgacactggaagaaatatttatctacgagatgggaggggcagattatgaagtcaaagacatcctgttttaaccgcacgatatttaagaagaacttcacgcatttctggccgctgtggctgctttaccagatatatctccttgtggtgattcccgtatgggtgtggcagaaggctgccagtccgtactactattatggaacggggaacgaggacacaacctaccgcatgtatcagctggtggagctggcagtacaccggatgatccctcctctgccggtctttttcttcgcagtggcagcggcgctggcagtgttttcctatctgtattcggcaaaaagcgccaatatgatgcatgcgttgccggtcaaccggctggaactttatgtgacgaattatctgtcaggactcatttttctgatcgtgccggagatcatcacattctttatcacagtgctcgtatgcctggcaaaccagtttacctgtatacagtatctgttcgctgcgctgttggcacaggctggtgtgacattttttgcatactcacttgcggttttcgtggcgatgttcacagggcaggcgtttgcaatgccatgctattatgtgatcgtcaactatctgtatgtgggatgcatgtttattgttgcaaaggtgattgaaaccatcagctacgggattgagaatgcatggaatccgggaaaaagctgcattttatcgccgctttattatctgaacaataatcttcgcagcagtcttatctacacggagaatgggaatggaattaccggcattaagatcacgggcatgccgctcatcggaatctatgcggcggcagcagttgtgcttgtcgtggtggcctgccagatgtataagaggcggcagatcgagacggcgggcgactgggtcagcatcgggatcatcaagccggtattccgctggggagcggcaatctgcggaggtctggtcgtcggtgtcacggtcatatccatgctcacggatctgccgcagctgcgcaaatatccgtggctgctgctctgcagtgtggtgatgggtttcctctttttctttggagcagagatgctgctggaaaagaatttcagggtatttcgcagaaaacgcgtgctggagtgggcggcgactgccgtgatcacagtggtgtttgtatccctgtttgaaatggatgcattcggtctggagcgctatgtgccggaggtggcggatgtggagacggcgttcgtctatctggattatccggtgcaggtgaaaggagaagaacttgcgacactgacggagctgcagcgccagattattgcaaataaggatgcctatcaggaggtagaacgtaccggttcgggattttattatacaacgttcctgtattatatgcaggatggttccaaggtggagcggcggtatgcacttccactgcctgaggcggatgggggtgctgacagtacaccggcagagcagatccttgcgtgggagagcgagccggagaatctggagcgtgagatttttggtatcggaaattcagagtgccggtttacctctggatatatggatctgtatacttctacggggcttaacaatacgcacatgttttccgagaaggagattgagcagatcttaaaggccatccgggcggatatcgaggatggaaatctggcgaagtattatcagtattgcgagcagccggaagacacgtactacagcaacattgaactggaatattatagtacaggcaggtatgttgacaactggatgtattattatgactatcacaacagtttagagaagctggaaggaaaagctgtggacgggcaggagatgacagcgggcggcaatctgtatctgacgttcggaccggactgcgtgcatatcgtagagacgcttgagaaacttggcatcacaaatgacgagtggaagctgatgacgaaccaagacatgatgcagtagaactacagcaggaagagaaattgccgcaataagcatattgtgctttgtgttgataagtaatatggtttagaaacatacttggggatttcatgtggaaatgcaggtggaaattcgtttgagaaaaatgtgagcatttcttccggctgaatgtttgcatcggattccgtgtctcttccacgtttggacaatccgacgggtgtatgtccgacacaccggagacaatgggcggactttctggtgtccctaatggcacctcttcacagacaatataaaaccgcgcgaaccgaactcgccggcatctgctattgaaaatagggcagatgccgactcagacagcggcttcgcgcggttatgttttgttcagaggtgccataagggacacacaaaaaagtcctacaaattgtctccgggatgcggacatgacccgcggagtgctccaaacttggaaagacacggatcatcgaagatgcaaacattcggttggttagaaatgccacatttgttgaaccgaatttccatttgcattttcatctgaaatcccaagggctggttttctaataatattacgtatcccacaaagaggtctatgcttattgcggcagttcctcttgcctgcctttgttaaactgctttacaagtcgggacagatattgtaaaatcaagcggtcaggattatgatagggacaggtgaagtctgcctgtcagtaagaagatggatgatactgttttttatagaaaggaaaggtcagatagatgagtaaacccgtagtagcggttgtagggcgtccgaatgttggaaaatccacactgttcaacgcacttgcaggagagcgaatttcaattgtaaaggatacgccgggagtgacaagagaccgtatctatgcggacgtcaactggctggattatcattttacgatgatcgataccggcggtattgagccggacagcagagatgtcattctctcgcagatgagagagcaggcggagattgccattgcgacggcggacgtgattattttcctcacggatgtcagacagggactgcaggattcggattccaaggtggcagatatgctcagacgctccggcaagccggtcgtgcttgtggtcaacaaagtggacagctttgagaagttcatgccggatgtgtatgagttctacaatctcggcatcggcgatccgttcccgatctcggcggcatccatgctgggacttggagatatgctggatgaagtggtcaaacacttcccggactatgcgaaggacgaggaggaggacgagcgcccgaaggttgcgatcatcggtaagccgaatgtcggcaagtcctccctcattaacaagctggcacaggaggaccgtgtgattgtctccgacattgcgggaacaacacgcgatgcgattgataccgacattacctacgacggaaaagaatatgtctttattgatactgcaggtcttagacggaagaataagattaaggaagagatcgagcgctacagcatcatccgtgcggtgacagcggtggagcgggcggatgtctgcatcatcgtgatcgatgcgacggagggcgtcacggagcaggatgccaagattgccggaatcgcacacgagcgcggaaaaggaattatcatcgcggtcaacaagtgggatgcgatcgagaaggatgacaagacgatctaccgtcacacggagaagatccgtcagattttaagctttatgccgtatgccgagattatttttatctccgcaaaatcaggacagcgcttaaataagatttttgagctgattgatgtggttattgcgaacaatagcatgcgtgtggcgaccggtgtcttaaacgagatcgtgacagaggcagttgccatgcagcagccgccgtcagacaagggaaaacgtctgcgcatctactacacgacgcaggttgcggtaaagccgccgaccttcgtgattttcgtcaacgataaggaattgatgcatttttcctacaccaggtatctggagaaccgtatccgtgagacgttcggtttccgcggaacggcactgaaattcattattcgggagagaaaggaagagcagtgatgataggagcaagggttattgcattgggaatcgggtatctgtttggactgtttcagacggggtatctctacggaaaaagccaggggattgatatccgcaatgagggaagcggcaacgcggggacgacaaattcactgcgcgtgcttggaatcaaggcgggactgatcacgtttgcgggagatctgtgcaaggcaattctggcggttcttctggtgaaggttctgttccggaacgcttacccggacgcagtcaggattctggaactgtatgccggcttcggagctgtgctcggacataattttccgttttacctcaagttcaagggtggaaagggaatcgcctgcacgtcgggcatgattctcgctgtgtgcccgatggcggcaccggtctgtctggtcttattcatcggttccatcgcgatcacaagatatgtgtcccttggatcgattctggtggtgacgagttatctggtgcaggtattgatcttcggacatatgggatatctgcatatcgatgccgcatatctcccggagttctatgtggtgagcgcctgctttacggcgatggcgctgtggcgtcacaggagtaacattggacgtctgctgcacggcacggagaataagttcacgttcaagaagaacaaacaggaggggaaataaaagatatggcaaaagtagcggtaatcggagcgggaagctgggggacggcgctcgcgaaagtgttgcacaccaacggcagccaggtgacggtgtggtcgattgtggaagcggagatcgcgatgctgcgcgaacggcatgagcatgtggataagcttccgggagtgaagcttccggaggatatggaatttaccacggatcttaaggcggcagtggaagataaggaatatctgattctggcggtaccgtctgtattcaccagaagcacggcaaaaagcatggcgccttttgtgaaggcgggacagatcattgtctgtgtggcaaagggcattgaagaaaatacgctgatgacgctctccgatattgtagaagaggaagtacctgcggcggaggttgccgtgatgtgcggaccgagccacgccgaggaggttggcgtcggactgccgacgaccgttgttgccggagcaaagaagcgcaaggtggcagagggcgtgcaggatattttcatgaatgaggtgttccgcgtgtacacaagcccggatgtgctcggcatggaactgggaggttccctgaagaacgtcattgcactggcagccggtatggcggacggactcggctacggggacaacaccaaagcggcgttaatcacgcgcggaatcatggaaatgtcgcgtcttgccatcaagatgggggcaaaggcggagacactgagcggtctgaccggaatcggagatctgatcgtgacatgtgagagcagacacagcagaaaccgcaaagccggaatgctgatcgggcagggctataccatgaagcaggcgatggatgaggtcaagatggtggtcgagggcgtgtattccgccaaggcggcgatcgcgcttgcaaaaaaatacggggtcgatatgccgatcatcgaggaagtcaactgtgtgctttttgaggataagccggcaaaagaagcagtgcgggaactgatgatgcgcgaccggcgtgcagagcatagtgccctggagtgggaagcatagaaatgcgacatggcaccccggagtggggagcatagaaatgcgacatggcgccccggagtgggaaacataaagaaatcgacataacaggaggaacatacatgccacagatcaggattaaatattttacggatgcgattgaacgtctgacctatattgacggaaagtcggactggatcgatcttcgggcgtctgaggaagtgacactgaaagcgggggagttctgtctgattccactcggcgttgccatggagcttccggagggctatgaggcgcatgtggtaccgagaagctccactttcaaaaattacggaatcatccagacgaacagctgcggcattatcgatggcacctactgcggggatgacgatatgtggcggatgccggtctatgcggtgcgcgacacggtgattcacgtcaatgaccgcatctgccagttccgcatttttgaaaatcagccgaagatcacgtttgacgaggtggagagcctcggcaacaaaaaccgcggcggattcggaagcactggaaaacagtaatgcgttcgtcaaagtgcttactttttgatggaaaacctgtcggtttgacgaaagaatagaaaaaacaaccaaaacactgtgacattctacaagaaaagcaaaaattctttgtgtaggcggtctatggtattttggctgttttttttgtatagtaagagtagttaaaaacgaacaaattttaggaggtatcgtaccaatggcaagtttatcattgaaaaacgtttgcaaagtatatccgaacggctttgaggctgttaaggatttcaaccttgaagtagaggatcaggagttcattatcttcgtaggaccttccggatgtggtaagtctactacacttcgtatgatcgcaggtcttgaggagatctcctccggtgagttctacatcgacggaaagctcatgaacgacgtagagccgaaggatcgtgatatcgcaatggtattccagaactacgctctgtatccgcatatgaccgtattcgacaacatggcattcggtcttaagttaagaaaagttccgaaggatgagatcaagagaaaagttgaggaggctgcaaagatccttgaccttgagaagttattagaccgtaagccgaaggctctctccggtggacagagacagcgtgttgccatgggacgtgccatcgtacgtaacccgaaggtattcctgatggatgagccgctctccaacctggatgcaaagcttcgtgtacagatgcgttccgagatcgcttccttacataacagattaaaagcaaccatcatctacgtaacacatgatcagaccgaggctatgacacttggtaccagaatcgtcgtattaaaggacggcgttatcatgcaggtagattccccgcagaagttatacaacgagccgaataacttattcgtagcaggattcatcggatctccgcagatgaacttcgtagatgctgtatgcaaggttgagggtgagaaagtaagcctttccttcgagaacacaacagttgttcttcctcctgcaaaagctaagaagttagctgacggcggatacaacggcaagactgttgttatgggtatcagaccggaagatatcggtgattccgagatcgagatcgaggctcataaggatgctgcattcgagacagatgtaacaggatatgagttattaggttctgaggtactgttatacttcaaagttgcaggcgcaagcatgactgcaaaggttgattccagaacaactgcacgtatgggcgaccacatcaagatggcaattgatccggagaagattcacgtattcgacaaagaaacagaattgacaattaccaactaatccgttagaattgaataggacttaaaagtaaaactgggtgcacatgttgtacccagtttttattaacgtatggaacacatgaggcatgtcaatgtacagtaatatttgacaggaaaggcgagacacatgatttcgaatcacaagatacaggcagcattagatgagataaaagagatttccaagattgatctggcactatatacggataagggaaagcaggtggcagcgacgtttgaaacggaaggggatatggagtacgctgtgaattcttttgcgggttccatggcggagagccagatgctgtccggatgtcatttctttaaggtgtatgtggacggggaactggaatatgtccttttgaccaaatcttctgcggaggacgcgtacatggtcggaagactggcggtctgccagatccggacgcttgtgtctgcttacatggagcagtttgaccggaacaacttcatgcagaatatcctgctcggcaatatgcttgtggtagatatgtacaacaaggcgcagaagcttcacatcgaacaggcggagcgcgtggtatttgtgatcgagctggaagggaagaaggacgccacagcgatcgaactggtcaagaatctgttcgcggcgaagaccagggattttgtgactgaggtggacgagcagagcattgtgctcatcaaagacaccagagagatgggagaggacgaggatctggtgtccctggcgtcaatgatcgtggacaatatgcatgcggaggcgatggtacgcgtccgggtcggctacggcaaccgtgtgaacaacctgcaggatattgcgaaatcctaccaggaggcaaagatggcgcttgaggtgggaaaaatcttctacgcggaaaaagagacgatcgcgtaccgttatctgggtattggcagactgatctatcagctcccgatgtctctgtgcgagatgtttattcatgaggtattcggggatgaaattccggatgtgttcaacgaggagacgacgacaacgatccagaaattctttgagaacaatctgaatatctctgaaacggcaagacagctttacgtgcacaggaacacgttggtgtaccgtctggagcgcctggagaaggtcatcggacttgatatccgcaagtttgatgatgcgatgacattcaagattgcaatgatggtcatttcccacatgcagtatgtcaagaatagtgaaaatgcactaaattagttgaaaaaatatatgctatatgttaaaattaaacaaaagacagcataagggagtggaagagttatggctggctatgtttacacgaatgagaactgtattgggtgcaaccggtgcatttcggtctgtcccgttctgacagcgaatcaggctgtcgtggtggacgggaagccgcgcattgaggtcaaccatgcacagtgcatcaactgtggtgcatgctttgatgcctgcgaacatcaggcgagggaatatgccgatgatacggagcagttttttgcggatctgcagagaggcgaatccatttcactgcttctggcgccggcatttcttgcgaattatcccagagagtatgagcagattttaggcggcttaagacagatgggggcaaagcggatcatcagtgtcagctttggcgccgacattacgacctgggcgtatatcaattatattacgaagaatcagtttacgggcgggatctcgcagccgtgtcctgcggtggtcaactacatcgagatgtatgcaccggaactgcttccgaagctgatgccggtacacagcccgatgatgtgtgcggcaatctacgcgaagaagtatttacatatcacggacaagcttgcgttcatcagtccgtgcattgcgaagaagaacgagatttccgatccggatacagacggctatgtttcttataatgtgacattcgatcatctgatggattactgcaggaagcaccggatcagtggaccgggggtcagcgatgagatcgaatacggtctcggctcgatctatccgatgccgggaggactgaaggagaatgtctactggttctgcggagaggatgtatttatccggcagattgagggagagcgccatgtctatgaattcctggatgcctatcgcaagcgtgtcgcagagcacaaggagctgccgtttatggtcgatgcgctgaactgtgcgatgggatgcatctacggtacgggcgttgagccggagaagactgccggggatgatgtgctctacgagctgcataagatccgggagaagagcaagaaggtcaagggaccgtgggcgagatcggcgacgtcgaagcagcggctggcacagctgaaccgtcagtttgcgcagcttgaaccggcggattttacgcgccggtataccgaccggtcgaaggggaatgagatccgcgtgccggagggccaggagttagaagcagtatacagccgtctgaacaagcagacggcgatggatcgtgcgatcgactgcagcgcctgcggttataagacctgccgggatatggcgacagcgatctacaacgggtgcaacagtgagaattcctgtattcattttatcaagaacgaggcggaggaaagagggcgtgcggcacaggcggctgcggaggaaagccagcaggcgaatgtggagatccagcgcagaagcgatctgattgcaggaattatcgagggactgaattccgattttcaggaactggattccgccatcgggcagatggctgccgggaatagcagcaatgcgagcgagagcacggcgattacggatgcgatgaccggcgtgaccggattctgccaggagatgcggcagtcgtttgaggcgatcacggagcttttggataagcttgagaacaacaacaacgacatcacgaagattgccaaccagaccaatctgctctcactgaacgcttccatcgaggctgcccgtgccggtgcggcaggcagaggatttgcggtggtggcggaggagatcaagaatctctcggagaacagcagagcaaccgcaaacgacagcaacgataacaagaatgagatcagtcaggcgatcggaaagctgttggaggagtcggatcatctgacagagattatccgggaagtggatgagcggatgaccaatctggcggcaagcaccgaggagatcgccgcatccacagattcggtgaaggagatttcctctgatctgaaggataaggcagccgagctgatgaacatgtaagatacaacagaaaagcaaatgataatacgcggacaaagaaagcaatcggattcttttccgcgtatttcgtctgtttgcacaaaaatagaaaatttttacaaaacatacgttctgttgcttgcacgggttttcccagtatgttatattatccagaggaatgtcaaggaaaggaagaagaacatggcaaagaaagagacttatgacgagagtagtatttccgttctggaaggactcgaagccgtaaggaagagacccggaatgtacatcggaagcgtgtccagaaagggtctgaatcatcttatttacgagattgtggacaacgcagtggacgagcatctggcgggtgcctgcgataccatatatgtcacattggaggcggatggctcctgtacagtggaagataacggacgaggcgtgccggtcggcatgcacgcgaagggcgtgtcggcagcgcgaattgtgtacacgacgctgcatgcgggcggcaagtttgacgattccgcatacaagaccagcggcggactgcacggagtgggttcctcggtcgtgaatgcactgtccacctatatggacgtcgagatcagcagagacggctacattcatcacgaccgctatgagcgcggtgtgccggtggtggagcttgagaacggactgcttccgaagatcggtaagacgaagaagactggaacgaaggtcaatttcctgccggacccggagattttcgagaagacgcgtttcaaggaggacgaggtcaagagccgtatgcatgagacggcatatttaaacccggagcttacgatcatctatgaggaccggagaggggaggagaccgagcatatcgtctaccacgagccggaaggcatcaaggggtttgtgaaggatctcaacaagagcacggaagttctgcatgacgtcgtgtattttaagggagagactgagggcattaccgtcgaggcggcgttccagtacacgaacgaatttcatgagaatattctgggcttctgtaataatattttcaacgcggagggcggaacacacatcaccggttttaagacggtgtttacgactgttattaatgcctatgcgagagagcttggcatcttaaaggataaggacgccaattttaccggtgcggacgtgcgcaacggcatgacggcagtcgtctccatcaagcacccggatccgcgcttcgagggacagacgaagacgaagctggataaccaggacgcgtcgcgggcgacggcgaaggtgaccggcgacgagatccagctctattttgacaagaacctggaagtgcttaagaccgtcatttcctgtgcggaaaaggcggcgaagatccgcaagaccgaagagaaagcgaagacaaatcttctgacaaagcagaagttctcctttgactccaacggcaagcttgcgaactgcgagagccgggacgcatcgatctgcgagatttttatcgtcgagggagattctgcgggaggttccgcgaagacagcgagagaccgcagctttcaggcgattctgccgatccgcggtaagatcttaaacgtggagaaggcgagcatcgataagattttagccaacgcggagattaagacgatgatcaatgcgttcggctgcggattttccgagggctacggcaatgatttcgatattacgaagctccgctatgacaagattatcatcatggcggatgccgacgtcgacggagcgcatatttccacgctgcttttgacgttattctaccggttcatgccggagttaatctatgagggacatgtctatgtggcaatgccgccgctttacaaggcgattccaagccgcggcgaggaagagtacctctacgatgatgaggcgctggagcgctatagacggagccacaagggcagttttacgctgcagcggtataaaggtctcggcgagatggacgcggagcagctctgggagacgacgctcgatccgaagagacggctgttaaagcggattgagatcgaggacggccgtatggcgtccgacatcacggaacttctgatgggcaatgacgtgccgccgcgcaagacctttatctatgagcatgcgacggatgcgaccgtggacgcatgacagatgcgataccgtgcggcaggatcatgcgcgggatgagagagccgcaggaagaagcggcaggaaatgaggattaccatgaaacaggaagaacagattatccgcaccgagtattcggagctgatgcagaaatcctatatcgactatgcaatgagcgtgattatctcacgtgcactgccggatatcagggatgggttaaagccggtacagaggcggacactttatgatatgtatgaactcggcatccgctatgacaagccgtaccgtaagagtgcgcgtattgtcggggataccatgggtaagtatcacccgcacggagacagttcgatctacggtgcgttggtggtgctggcacaggattttaaaatgggacagacgctggtggacggacacggcaacttcggctccatcgagggagacggagcggctgccatgcgttacacggaggcgagacttcagaagctgacgcaggaggcgttcttagcagaccttgacaaggatgtcgtggattttgtgccgaactttgacgagacggagaaagagccggaggttctgccggtaaaggtgccgaatcttctgatcaacggtgcggagggaattgcggttggcatgacgacgagcattccgacgcacaatttcggcgaggtcattgacggtgtgattgcctatatgaagaatccggacatcaacaccgagcagatgatgcagtatatcccgggaccggattttccgaccggcggtgtgatcgccaacaaggacgagttgacagccatctactccacaggcgtggggaagatcaagatccgcggaaaagtggaggttgagcaggtcaaaggcggaaaggaacgcctggtaattaccgagattccgtatacgatgatcggtgcaaatatcggaaagttcttaaacgatgtctacagcctcgtggagacgaagaagacgaatgacattgtggatatcacaaaccagtcctccaaggagggcatccgcattgtcatcgagctgcgcaagggagcggacgctgccaatctggagaatctattatataagaagaccaagcttgaggacacgttcggtgtcaatatgcttgcggtggtagacggaagaccggagacgatgggaattgtgccgatcatacgtcatcatgtgaatttccagtatgagctggcaaagagaaagtatacaacgctgcttgccaaggagctggagaagaaggaagtgcaggagggattgatccacgcctgcgatgtgatcgatcttatcatcgagatcctgcgcggcagtgcgaacgtcaagatggcgagagcctgtctgaccgagggaatcatcgaggggattgcctttaagtcggcgcagtcccaaaaggacgcgcagagcctgcgttttacggagcgccaggcggatgccatcttagagatgcgtctgtacaagctgatcggactcgagatcgaggcgctgatgaaagagcacgagaagacgcttgccaatattgcggagtacaatgagatcttaagcaaccgtgcggcgatggcaaaggtgattatccgcgagctggaagcttacaaaaaggagtatggcagaccgcggcgcactgtcattgacaatctcaaagaggcggttgtcgaggagaagaagattgaggagatggacgtggtattcctgatggatcgctttggctacgcgaagacgatcgacgtggcggcgtatgaacgcaaccgcgaggcggccgatgcggagaaccgctatgtgctgacctgtaagaataccgataagatctgcatttttacgaacaagggacagatgcatctgctcaaggtgctggatctgccattcggcaagttccgcgacaagggaacgccgattgacaatctgagcaattataacagcagtgaggagaactttgtctatatcacgaatctgggagcgatctgcaaccacaggctgatctttggcacgaagacggcgatgcttaagattgtggacggaagcgagtttgacgttgcaaagcgcacgaccgcggcgacgaagcttaccgacggggacgaggtgcttttcgtgcatccggttgccgggaatgagacgatcgtcatgcagtccgagcgcgatttcttccttcggattgcggtggataccattccggagaagaaaaagggtgcggtcggcgtccgcggcatgcggcttgcggacggagatgcgcttactgcgattcatctgctcggcgagggtgagagcgcccagacggaggtaaaaggaaagcctgtgatgttaaaccggctgcatgtggcgggccgcgacacgaaaggaacgaagaaataacgatgataaaagctgtattatttgatctggacggaacgatcatcaattccgaggagggcatcacaaagtgcgtgcaatacgcactgcgcgcctacgggatcgatgagccggaccgcacgaagctgcgctgctttatcggaccgcccttagatccggtatttcgcgaaaagtatggcatgacggaagcggaagcgtggcagtctgtggaaaagtacagagagcggtttgacgtaaagggaatcttcgagtgcagcctctacgacggcgtcagggaagcgatcgcgcgcttcaaggagcatggttatctgcttgcgcttgcgtcttcaaagccagagacagcgtgcagaagaatattagagcactttgatctgctgggatattttgatgaggtggtaggttccacgctggacggctcgatcagtacgaaggcggaagtgctcgaggaactggggcgccgcatggcgggcagccatatcgggaaaaacgaactgtgcctgatcggggacacgaagtatgacgctgccggagcaaaggcgttcggaatccgctgtatcggtgtcagctatggcttcggtaccagggaagaactgctcgccgcaggtgcggaggcggtcttcgaccgcatcgaagaggtggagacatacattgagaatgacgcagcgggagagggagaggcagagtgaagacgacaggtgcttataaaatctggagaatcatatatccgatcggtatctattatgtggtgtcatcgcttgcctacttttttctgacgctgctgctcggcgcgggggaggaatcctacatgctgcggcagatgctctgcgcggctgccacgattccgttcgtctggatgcattacgggcaggatcgcgctgcgcgggagactgtctatggcaggcgcggcatcagaccggacgcaaggtttttctgcactgtggcaggctcactgcttgcaggagcatctcttggcatggctgtcaacaacgtgattgccatgacgccgctcattgaggcgtccgcgggctttcaaagcgcgaatcaggcgttttttgccggcggggttgtgtttgaactgctcggctcctgcctcgtgattccgctggcggaggagcttttgtaccgtggtgtcgtggagagaagactatccctgctgtgcggcagtgcgccggcaatcgtgctctcggcggttattttcggcgtgatgcactggaacgtggtacagtttttgtatgcgggcattttaggtctgctgctcgcgtggctgctggagagaaccggctttttgtatgcgcccgttctggcgcatatcggggcgaatgtgatggcggttgtgcgcagcgagactggctggctggactttgcctaccagcccacagcggcaggtgttgcagtgacggtgctgctgtttgcggtggcagcgtttgcggttctgctggtgaaaaagggcggagtgcggcaggaagaggagaaaacgtccgctgcctgaaaccttagcagtatctgtagaggtgcagttattgactgttatagcttcctgtggtatgttaaatgacgtgaatggcgggatccccggtccatttagcatcgcaggaaggagagtgacagtttcatggacgatagtgcggacagtgacagcgatacacagatatgcaggcttttaaaaagagaatacggctgctccatgcagtgttatgaataggtaaaggtatggcttaccggaggtcttttttggacaccggaaggtcatacctttttgtgcgtaaatgacacaacacgtaacaggcagcaggagggcgtatcacaggacgccggaaacagaaaggagcagacatgttgcagcccatattcttattgatggttttgatttttttgaatgccgtatttgcaagcgcggagattgcggtaatctcgatgagtgatttaaaactccgacagctctgcgaggcgggagacaggcgtgccggaaagctggaggcgctcataaagcagccggcaaaattccttgccacgatccaggtggcgatcacgctcgccggatttttacagagtgcgtttgccgcggaaaactttgcacagccgttggtgacgcttttgaggggcaccggaataccggttgcagaggaggcattaaaatccgcgtgcatcgtggtgattacattgattttagcgtattttaatctggtcttcggggaacttgtgccgaagcgggtggcgatgaaaaaggcggaggagctggcgcttaaaatggcaggaatgctctccctggtggcgaagatctttgcaccgctggtgtggcttcttaccgcatcgaccaatttctggttaagacggtttggcattgacccggaggaggaagaggagacggtgtcggaggaggaaatccggctgctgctcgccgagggaagagagcagggaaccattccgaccgaggagacagagatgatacagaacgtgttcgggtttgatgatattgcggtcggaacgatctgcacgcaccgcagggagatggtatctctgtccacggaggaggatgaagccgtctgggatcggattctggcggagagcgtacatacctattatccgatctttgcggggagaagcgaggatgtcgtgggaatcctcgatggaaaagcgtatttccgcatgaaagaccacacgcgtgacaaagtgatgcagtgcgcggtacaaaaaccgatgctggcagcggattccatgaaggcaaaccggctttttgagcagatgaaacagcagcagaattattttgcggttgtgacagacgcctacggcggggttaccggaatcgtgacgctgtgcgacatcatggagtatctggtgggagatctggagaatacggttaccgcataaaatggtgttataattcagatacaatttaagaaaaggcagaaaaagagcccggaaaaagttttgcatgcaaaattttttccgggcttttatatgttgaattgtgtgtgagaaaattatttatacaaaaaataatgaataatatctgataataataaaaaataaacattatatacaaataatcagacaattataagaataaactggtagacaaacaaatgagaaagttgtatattaggatataacaaattcggtaaagacaactgtccgtgcagtaaagacagctgatcggaatacagaatgcagaaaggaagctgattatgaaagagcagaccacttataagaaggacgccctcaaccgtttctcggtatcggatgcggggaagcaggcagccggaatgtacgatccgggttacgagcacgataactgtggtatcggttcggttgtcaacattaagggaatcaagacacacgagactgtggagaatgcgttaaagatcgttgagaacttaaagcacagagcaggcaaggatgcggagggaaagaccggtgacggtgtcggtattctgctgcagatatcccacaagtttttttccaaggcggcaaaacagcttggaatcgaactcggtgaggagagagactatggtgtcggcatgttctttttcccgcaggacgagttaaagcgcaaccgtgccaagaagatgttcgaggtcattgtcggcaaggagggaatggagttcctcggctggcgtgaagttccgaccgatccgacgaagctgggacagaaagcggtggactgcatgccgtatatcatgcagggttttgtgaagcgtccggcggatgtggagaagggactggcgtttgaccgcaagctgtatgtggcgcgaagagtcttcgagcagtccaacgacgatacctatgtggtatccctttccagccgtacgatcgtctataagggaatgtttcttgtggagcagcttcgtctgttttttgcggatttacaggataaggattacgagtcggcgattgcaaccgtgcattcccgtttctccacgaacacgaacccgagctgggagagagcgcacccgaaccgttttatcgtacataacggtgagatcaatacgatcaagggcaacgccgataagatgctcgcccgtgaggagacgatggagtccgagcacttaaaaggcgaacttcagaaagtgcttccggtcatcaacagtgagggatcggattccgcgatgctggacaatacgctggagttcctcgtgatgagtggtatggagcttccgctcgcagtcatgatcatgatcccggagccgtgggcaaacaacaatatcatgtcgcagaagaaaaaggatttttaccagtattacgcgacgatgatggagccgtgggacggaccggcatccatcctcttttccgatggcgatatgatgggagccgtgcttgaccgcaatggtctgcgtccttcccgttactatattacggatgatgattatctgatcctctcctccgaggtcggcgtgctggacatcgacccgacgaagattgtggtaaaggagcgtctgcgtccgggcaagatgctgctcgtggataccgtcaagggaagagtcatcgatgacgacgaactcaaggagacttacgcgaacaagcagccatatggtgagtggcttgaccgcaacctcttaaaactcgaggatttaaagatcccgaatgagcgtgtgccggagtataccaaggaagagcgccagcgcatgcagaaggcattcggttatacctacgaatctctgcgcgaggcgatcctgccgatggcgaaaaacggtggcgagggtacatccgccatgggtattgacacaccgcttgcagcgcttgcgagtgaccatcagccgctgtttaattacttcaaacagctgtttgcgcaggtgaccaacccgccgatcgactcgatccgtgagaaagtcgtgacctctacgaccgtctacatcggcgaggacggcaacctcttggaggagcgggcggagaactgtaaggtattgaaggtcaacaacccgattctgaccaacaccgacctgatgaagatcaaggcgatgaaggtcgacggattcaaggtagaagtactgccgattatctactataagaatacaagcttggagaaggcgatcgagcgtctgtttgtggaggcggatcgtgcgtaccgtgagggagcgaacattctgatcctctccgaccgcggcatcgacgagaaccatgtgccgatcccgtcactgctcgctgtatcagcactgcagcagcatctggtaaagacgaaaaagagaacggcggttgccatgatcttagagtccggagagcctcgtgaggtacaccattttgcgacgctcctcggctacggagcctgtgcgatcaacccgtatctggcacaggataccgtaaaacagctggtggacgagcatatgctggacaaagattattatgcggcggttcaggattacaatgcagcgattttaaacggcatcgtcaagatcgcatccaagatgggaatctcgacgatccagtcctacgagggttccaagatcttcgaggcgatcggtatcaataaggatgtgattgacaagtatttcacgaatacggtcagcccgatcggcggcattacgctggaggatattgcggatgacgtcaatgagcttcactcggcggcgtacgatccgctgggattagagacggatctcacattggacagcagaggacgccacaagatgagaagcggcgcagatccgcatctctacaatccggcgacgattcatctgcttcaggaggcgacaaagcgcggcgactacgaactctttaaacagtacacagagcttgtgaataaagaagagagagagatcacgctccgcggtctgatggatttcaattacccgaaaaagggcgtgccgctcgaggaggtcgagagtgtcgattccatcgtgacgcgttttaagacgggggcaatgtcctacggttccatctccaaggaggcgcacgagacgttggcgatcgccatgaaccgtctgcacggcaagtccaactccggcgaaggaggagaggatgcagaccgtcttgcgagcaagaacagcccggtcaaccgttgctctgcgatcaagcaggtggcgagcggacgtttcggtgtgaccagtgagtatctggtgagcgcgcaggagattcagatcaagatggcacagggcgcaaagccgggcgagggcggacacctgccgggcaagaaggtctatccgtggattgcaaagaccagactttccacaccgggtgtatcattgatctccccgccgccgcatcatgacatctactcgatcgaggatctggagcagttgatcttcgacttaaagaatgcgaaccgtgatgcgcgcatcaccgtgaaactggtatccgaggcgggagtcggtacggtcgcagccggcgttgcaaaggcaggcgcacaggttgtcctgatctccggctatgacggcggtaccggtgcggctccgtccagctcgatccacaatgcgggacttccgtgggagcttggtcttgcggagacacatcagacattgattatgaacggactgcgcaacaaagtacgcattgagacggacggcaaactgatgagcggccgcgatgtcgctacggcagcgctgctcggagcggaggagttcggatttgccacagcgccgcttgtgaccttaggctgcgtgatgatgcgcgtctgtaacctggatacctgtccggcaggtattgcgacacagaacccggagcttcggaagcgttttgccggcaagccggaatatgtggagaattttatgcgctttatcgcacaggatctgcgggagtatatggcaaagctcggatgccgcacgatcgacgagatggtcggcagaagcgatctgcttaaggtgcgcgaggatctttcgggacgcgaccgcgagatcgatctctccaatcttttgaacaacccgtttgcgggaccgaaggagaaagtaacctttgacccgaagcatgtctatgattttgaactggagaagtccaaggatgtgaccgtgctcttaaaacagttaaagggtgcgttagagcagaagcagcgcagaagcattgatgtggaggtgacgaacaccgaccgttcctttggtacgattttcggttcggagatcacgaagaagtacggcggagagggactgccggaggataccttcattgtaaaatgcaacggtgccggcggacagagtttcggagcttttatcccgaagggactgacgttagagctggtcggcgattccaacgattactttggaaaaggattatccggcggcaagcttgtcgtctatgcaccggcgggcgtgaagtatgagaaggatgagaatatcatcatcggtaatgtggcgctctacggagcaaccagcggaaaagcgtttatcagcggcgtcgcaggcgagcgtttctgcgtgcgcaactcgggagcttccgcagtcgtggagggtgtcggagaccacggatgtgaatatatgacgggaggccgtgtcgtcgtgctcggcaagaccggcaagaattttgctgccggcatgagcggcggtattgcttatgtgctcgatgaggacaatgacctctacacaagaatgaataaggaaatggtattcagccaggagatttccaacaaatatgatgtcatggaattaaaggacatgatcaaggaacatgtggcgctgaccaactcggaaaagggcaagaagatcctggataatttcagcgagtatctgccgaagttcaagaaagtcataccgtatgactataaccgtatgcttatggcgattgttcagatggaggagaaaggtctttcttccgaacaggcacagattgaggctttttatgcaaatacgcgtggatagtgtgtgagcaggtgtcgtttgacatgtgtgactcatgcattttcgagaaaggaaagaattatgggaaaaccaacaggatttatggaatatgacagagaagatgcccgcgccattgagccgaaggagcggatcaaaaattttaatgagttccacattcctctgtccaaagagagacaacagattcagggcgcgcgctgcatgaactgcggcgtgccgttctgccaggcgggaatgaacatcatggggatgacctcgggatgcccgctgcacaacctggttccggagtggaatgatcttgtatacacggggaactgggagcaggcatacaaccgcctgaagaagaccaacaatttcccggagtttacctcccgggtatgtccggcactctgcgaggctgcctgcacctgcgggcactgggaagatccggtgacctgcaaggcgaacgagcacggaattatcgagaatgcgtatgagcagggttatgcggcggcaaagcctccgaaagtgcgcaccggcaagaagatcgcggtgatcggctccggtcctgcggggcttgcggcggcggatcagctcaacaagcgcgggcattctgtgacggtctatgagcgggacgacagagtcggcggacttctgatgtacggaattccgaatatgaagctggaaaaatgggtcatcgaccgcaaggttgccgtcatgaaggaggagggcatcacctttgtgaccggcaccaatgtcggaaaggatgtaaagtcctccaagctgttaaaggagtacgaccgtgtgattttagcgtgcggcgccaagaatccgagagacatcaaggcaccgggacgggacgccaagggaatctatttcgccgtggattttttaaaagcaacgacgaagagtctcctggattctgagctaaaagacggcagctatatctccgcaaaagggaaaaaagtggtcattatcggcggcggcgataccggaaatgactgcgtgggcacgtccatccgccacggctgcgcgagcgtgacacagcttgagatgatgccgcaggcaccggcaaagcgcgcggagaataatccgtggccggagtggccgaaggtgttaaagaccgattacggccaggaggaagcgattgcggtgttcgggcacgacccgcggatctatcagacgacggtgaaggaattcttaaaagacaagaacggcaatctttgcgggcttgtcactgtaaagctcgaaccgaagcgggatgagaagaccgggcgtgtgacgatgaccgaggttgcgggaagcgagcagaagatggaagcggatcttgtgctgatcgctgccggattcctcggcacggaaaaatatgtggcggacgcgttcggtgtggacttaaacggcagaaccaacgtcgcaacggcggagggcgcctatgagaccagcgtgaaaaatgtgttcgcggcgggcgatgtgcacagaggacagtcccttgtcgtctgggcgattcgcgagggacgcgaggtcgcgcgcgaggtcgatgagagcctgatgggctactcctaccttgaggtgcagtaatcgaatgataatcccccgtttgtaatccaacggattctgtgctaagatgagaaaaaagagtacgaatgaagaaaaggggagtacaaatgagccgcagaaggaaaaaagcaggggaaaaggcgcggacgatggcgggaagcgcagaagcggaaaagacggcagcgggaagcacaccggcagagcaggaggcagggagcacatcggcgaaagagacgttatcggcgagcatagagccggcggagagatcggaaaatgaggcggaggtctggcagaccggcgcgcgggtccggatcgcggatatggagccggattactcggatatcacagtgaagaatccgcgcatcggcaaggtcatgcgccttgaggaagaggtccagagacagagtgagatcgagaagctgcgcagcagacggatccggcaggagcaggaatatattgaccggatgagcctgtcggtggagaatcatctgcgcaataccaaggaagagcagcggtacaacgagcagttcgaggagcgcatccgcacggaagtgtaccggatgcacgggatcagtgaggacaagctgcaggggatgacggagtaccgcaatgcgtggtatcagggcacggcgtttgccatgtttttcctgtcgctcgtgctgatcgcgatctgcggcatactgcacgggttcgggtcggagatctgcatttttatggcattttatacggccattgagggggcattgctctccaacgggaggaagcagtcactgttttttacggtgctgacgaagggcgtgtatctgctgctgtttccggttatgctcgtgacgtttacctgctacgaacttggttttgaggaatatgcgcttctggtaccggttttcgccgtggcaggtgttgtggtgctcatgatcggagcactgtcctacttcctgtatgatccgtaccggatggaccggaggaaccgcaagaaggcgaaccgctatatcgtagagatcgagaaggcagcgctaaaggaagtgcgtctgaaggaaagggcgttcgcgaagcaggagaaaaagcaggcgaagtttaccagaaaggaagaggcgagagcgcagaagaaggcagagcgggacgagcgccgcagacagcggaaggaggcgcgggcagaaaggcatgcacgctggcgcgcatggtggagcgagaagctggcgcggcttaagtttgtgaagaaagaatctgcggatgagacgcataagagtccggcgaatgcagatactacggaggaacattctgcggaaggagactctgtggagagggaatctgcggagagagattcggcagaagcagaatctgcagagagagaatctgcggaggaacattcgacagaaggagaagttgcaaagagagactaggcggagggaaattccgcggagaaaaacactgtgaaagaagcgtgtgaaaatgagacgactggggattgatctttcctattttttcacatatgaagatgagataccggacggggtgggattttcccactttggtccggtacatttattatggctgggcgtgtgcgcggggctcttactgctgttcctccattattataagcgatggggaggacggcgcaggcttttggcggagagaggaatcggcatttttctggtgggactggaagtgtaccggattgcggtgctggctctgatcgggaaaatgtcgctgtatcaactgccgcttcacctgtgcagcatggcagggtttttgtgctgtcttcacgcctttttcaaatgggactggctgggacaggttctctataccctgtgtctgccgggaaccgtgcttgcgcttttattcccggactgggtgcgctatccggcgattcattttattacgatacagggatttaccttccatgccgggattgtgctctacgtgatctgccagctgttgcagcacaacattatcccgcggcttgcggcgctgtggaaggtgatcgtatttcttctggtggttgtgccgccggtttacctgtttgacaaaaagtttcatgccaattacatgtttgtgaatgtgccttcgcccggatcgccgctggagtggctggcgtcgtttctggggaacccgggctatctggcaggctatgcggttctgatgcttttatgcatggtgctcatggacgccggttaccggctgttgcttgacaggaaaagctgcggaacgtagaataaaacgaaaaagagagaagcgctacggatattgcaggagaagaattgctgcgatggggtgcgcagaaatgaggagcatatggcagattttacattttcaacactgaaatacgagagaccggatttcacagaagtggaacagctttttgaaaaactggtaaaacaggtacaggaggcagcctcctatgagggattaaaggaactcttaaagaaggcagagcgcgtgcagaataagcttatgactgcgtgcacgattgcgtccatccgccatacattagatacgacggatacttattatgagaaggaagacgaatatatcaacaataccataccgaccgtgatgccgaagtttcttgcatttgatgcggcagtgatgaatagtccgtttcgcgatgacatcgagaaagagtacgggaaacagtattttgcacagaaggaactgaacaggaagactttctgtgaggcaaatattccgctgatgcagcaggaggcgaagctgacaaacgaatatcagaagatcatggcaacggcggcgatcgaatttgaagggcagacgcttaatctctatggtgtacagaagtattttgaacatgaggacagagaagtacggcgtgcggctgtgcgggcatattctgatttttaccacagcaatgagaagcggctggaggagatctgggaggaactcattaccatccgcaatcagatggggaagaacctcggctatgccaactttattccggtggggtacatgcagcagggacgcacggattatggggaaaaagaggtggcagcgttccgcgagcaggtgcgtacggaactcgtaccgctgtgtgaacagctctatgcggcgcaggcgaagcggattggtgtggatacattgatgttttatgatgagaagcgtgtatttccggatggaaatgccgttcctgcgggagatgatgattttatggtggaagaggcaaggaagatgtaccataagatcagcccggagactggagagttcattgattttatgattgagcacgaactgatggatttgaagaataagccgggaaaagctgctacgggatatatgacatttcttccggattatcaggcaccgtttgtgttctccaattttaatcagacaatctttgacatgcaggtgctgacacacgagctgggacatgcgtttgcaggatatatggcaatgcgcagccagccgattgcagagtactactcagagtctaccgacattgcggagattcattccatgtcgatggagcagttttcctatccgtatgcggaggcatttttcggaaaagatgcagataaattccgctttgcacatttgatggatgcgatcacatttgtgccgttcggtgtggcggtggatgagttccagcacatctgctacagcaatccggatctgacgccgaaggagcgcacggcggagtggaagaagctggaagagaagtatatgccgtggagaaaatacgacgcggatgatttctttgaccgcggtggtttctggtaccacaagctgcatatctatctctatccgttctattatatcaactatacgctgacgacgatgggagcgatggagttcaaaaagaaaaattatgagaaccacgagacagcatggcaggattacttaaatctctgcaaatgcggcggaagcatgagctatctggagacattgcgctatgcaaatctgtcgaatccgtttgcgccgggcagtgtggcacgtgcgatggaagtagcaaaacaggaactgatgaacagtccgtttatgagatagtatagaagcagtgttggatgagtgagaaacggaggtaagattgtaatatggaagaaatgttggaagtgatgaaaaaacagttgaaaatgcagaagcttatcagcgggctgctggcggtaatgctggtaattctgctcattgcgggtggattttttgtcaaccggatgagtcagatgacggcagcaatgagtgaggcggcagataaactgcagcaggtcgatgtggatggtatcaatgatgccatcggaacgacgcaggaaatgctcgagagtgccggagagctttccgatgcggtcgattccgtgacattaaaagtaaaagagttcaatgactggatgtcaggactttttggaaattagcaggcgttaataaaaacaaaccggcgaggcgagattgcggagcagggctaccgcgctccagccggcgattgcgctggtggaagagcagatgtccacggtggctttgacgccgtcgatctctgcggtgatgcagtggtcatcgcccgtccagcccggaacggagtgcatggttacctgcgtgatgtccggtcctgtcgtggcgagcgaggtggcgacggcgacgttgacgcggcgcggaaaggttgcgatcgcctccttggcgctgccggtaaagacagtcgtcttttcggtatcggttaaaaggtgttccgcccagaccggtgtattgcgaaaaccgcgggcgccggtgtgcgtctcgatgccggcggtctcgtcaagctttcccgcctgcgccattaaagtgatcgtctgtaagacgtcaaaaccaccgatcgcgccgtttgccagatggactttggcgcatcccctgcgggctgcgtccctgacctgcccgtaaaaggcagcgtcggcaaacgcaccgatcgagaggagaacgaggctgacgccgtgttcgagtacggtgcatgccatatcccggacagcttccacggacgctgcctccacaatatattccggctctaaggagagcagttctgcaagatcccgacaggatctgcagccggtttccgcagcggtcttatcgcgcgattcctgtgagcggctggtcacgccgacgagctcataatcttccagaaaaccatccttccaggcgtttgcgacaatgtttccgagaaaaccgcagcctacaataccaaatcttatcttcatcgtaaaaatcccttcgttatctgaatttattttgatcctttttcatgcttttcttgctgcccaccttttgacaaagttccctttttggcagaaaactcttttgttgcaggagtccgttttgtcccgggagttcctttttttgcaccgtttccctttttgcccggggtgtctttccggacgctgtagccgaatgtgccgagctttttcccgagaagaaaatactctccgtgcgagtaggtgatcagcccggtgtcgtttaagtggaatttgccggcttcatccatatacgcgtcatcgatggtgacagcgacgacgtccgcaaggatcagattgtggctgccgagcggcgtgatctggcgcacacggcattcgatattgacgggactctcggcaatgccgggaaccgatacctcacgggaggcaagcggcgtcagatgcatctccttgaacttgtcgacgtctctgccggagcgcacgccgcagtagtcggtggcacgtacaagcgcttcggttgtgagatttaccacgaactcaccggcggtctcaatcatgtggtaggagtagcgctccggacgaacggagatggagagcatcggcgggttcgtgcagacggtgcctgcccaggcaacggtaagaatgttcggtctgcctgcgagggcaggattgctgcattccggatcggatgcgccgggatactggcagcttaccatgacggcaggcagcggatagagcatgttgccgggtttgaaagcactttttcccataaaataaggactcccttctgtctgtgaaaaatatctgtgtctattgcatcagaatgtccatcagatatgcgtagacatcctcgttctgttttttccagttgttgcagatcgcctccgcctgttctttgtttttgacggtcagtgtcaggtcgattaagttggtatcgtggacgcggaactgacagcgcacggcatagtcctgattcggcgtcttgtaatagtctgcgatgatcgagttgacggtgcggagcgccattttatttttttcaaaataggcgatggtgtcatgctcgatcgcgtccgtgagcttgtcgcggaaaaagccgagcgtctcacgccccgcggcggtgatgtaatactgcgtgttgctgtgtgtggattccgtgcggatcagaccggagtctgcgagatcgtttaagacctgctgtacccggaaataatccgtgtattcctgctccagaaaaaagtcggagatctgcgtgttggtcagcggaaaatcgaccttatccagcatatttaaaatggtcagtttgtatatggtaaatggttcagccatgtgtttcctcgtttctataatatttgccctgccagagatcgcgctgtacaagttgcctgtttatcgtgtttaacacgcgctttttgtccgtgctccacagcggagcgaggagcaggcggcgcggtccatcgccggtcagacggtggatgaccatttccggtggaagaagggcaaggcagtctgcgataaggtcgcagtattcctccagcgtaaacagcggaaatggattggttttgtagtgcgttccaagatcggtaccctttaagacgtgaagcagctgcagctttacgccgaagaccggatgtgcggcaagatagcgcacggaagcgcgcatatcttcggttgtctcaccgggcagacctaagatcagatgtgttatgaccttgatgccccgcgcgtgaagcgcggataccgcctgctcatactgggcgagtgaaaaaccgctgcgtatcaaatgcagggtatgttcgtggatggtctgtaaaccgagctccacccagactggttttatggtatttaattctgccagcagatctaaaacctcaggcggcagacagtcacatctggtggcgatggagagcgccacaatgtcgggctgtgcgagagcttccgtgtaaagcgcacgaagaacaccgacgggagcgtaggtgttcgtgtatgcctgaaaataggcgatatatttgcggcagtttgttttttccagaaggagaagctttgcctgcgcaatctgttcagtgacagattgctgcggggaggcggcaaaatcaccacttcctccggcactgcagaagatgcaccctctggtatcgatgctgccgtcgcggttcgggcaggtcatgccgccgtttagagacaggcggtagaccttttcgccaaatgtctggcgtaaataagtattgagggaatagtaacgcgcgtcgttcatgatacgtccggttaacgcacgatgtgagagcggacggcttcacttaccacctgtgctacccggggatcaaaagcttccggcatgataaattcgtcgtttaactcctcatcggacacaagaccggcaatcgcctctgcggcggcaagcttcatctcttcggtaatctgtgttgcccgtccctcgagagcgcccttaaagatgcccgggaatgccacgacattgttgacctgattcgggaaatcactgcgtccggttccgacgattctggcacccgcagcctttgccacatccggcatgatctcaggaaccggattcgccatggcgaacaggatggagtcgtgattcatggaagcaaccatctccggggtaacgatgttcggtgcggagacacccacaaaaatatcagcaccctttaaggcgtcggcaagcgtgccgtgctgatcctcaaggttggtgacttcggtcattttctgctgcatccagtttaagttcgggtaatctttgccgatgatgccctcgcggtcacacatggtgacatggcgaaaaccgtaggtgagcagaagctttgtgatggcaacgcccgcggaaccggcaccgtttacgacgacgcggcagtcctcttttttcttgcctgtaacacgcagaccgttgataatgccggcaagcacaacgatggcggtgccgtgctggtcgtcatggaagaccggaatgtcgagcatttctttcaggcgctcctcaatctcaaagcagcgcggtgcggaaatatcttccagattgatgccgccgtatgcgggagcaatgttcttgatcgtggcaatgatctcctccgtgtcctgggtgtcgagacagatcggtacggcattgacatcgccgaattccttaaacagaacgcattttccctccatgacaggcatggcggcatatgcgccgatattgccgagaccgagaactgcacttccgtcggaaatgacggcgacggtgttggctttcatggtatatttgtaagcagcctccgggtctttggcgattaccttgcagggctcggcaacacctggcgtgtatgcgatggcgagatcttcgcgggagtttactttggattttgcgatggtctcaagctttccgttccatttttcgtgcataagaagtgccttctcggcaagtgtcattgtctgattctccatgatataatctcctgtatataaagtgtatttttatatagaaaccaatacgtaaatcataccattatcattttgacaaatcaaggaaattaggacttcctattttggaaaaagtgttgtataatacgcatattgtaaattcattttgtcaattcagacacgattcccaatacgattgagagcatagaggaaaatagcagattgataagaacaggagcgaatggatgagagaaaagtatgagagcttgtcagccgttgttttgcgtgatcttgcaaaagcgagaggactcaaaaatatctccggcatgaaaaagagtgatctggtagatctgatggttgcagaggacgagcgtcagagcaaagaggagaatacgaagcagcgtgagcagacatcgcagcgtgagcagacaccgcagcgagagcaggcgcagcagcggccggcgcgggaacccagagagggacgggagaacccgaaggagagcggtgcagtggatgagacgatctcgaatctggacagcggaattatggcaaacggtattttagaggttatgccggacggatatggatttatccgctgtgagaattaccttcccggggagaacgatgtgtatgtatcgccgtcacagatccgcaagtttaatctgaagacgggcgatatcgtggcgggcaatacccgtgtgaagacacagcaggaaaagttttcggcgctgttatatgtttcatcggtcaatggttaccatccgggtgtcgcgcagaagcgcaagaattttgaggatctgacgccgattttcccgaaccggagaatccgcttggagcgcccgggctgcagtgtcgcaatgcgcattgtggatctggtatcgccgatcggaaagggacagcgcggtatgatcgtatcccagccgaaggcaggtaagaccaccttattaaaagagattgcaaaatcagtgacaaagggaaatccggatatgcatctgattattttgctgatcgatgagagaccggaggaggttacggacatcaaggaagcgattgtcggggagaatgtggaagtgatttattctacgtttgatgagctgccggagcatcacaagcgtgtatccgagatggtgatcgagcgggcgaagcgccttgtggagcacggaaaggatgtcatgatcctgcttgacagcattacgagactggcaagagcctacaacctcacggttccgccaagcggacgtacgttatccggaggtcttgacccggcggcgctgcacatgccgaagcgctttttcggtgcagccaggaacatgcgtgagggaggaagcctcacgattcttgccaccgcgctggtggataccggaagcaagatggacgacgtggtattcgaggagtttaagggaaccggcaacatggagctggtgcttgaccgcaagctttccgagaagcgtgtgttccctgccatcgacattgtgaagtcgggaacacggcgcgacgatctgctgctggagccggaggagcaggaggctgtcgagatcatgcgcaaggcgatcaacggtatgcgcaccgacgaggcggtggagaacattctgaacatgtttgcccgcacgcgcaacaatcaggaatatatccatatggtgaaaaagaaccggattgtataaaaagaacttgattttttgtaaaaaccatgataaaataacaacgctgtttattcgggactattctttgcaataagtgccatatgcggatcgggcatacgggcataagagaatagagacagacaggaacataataacgataagattataaagaggtgaaaatcatgaaggcaggaatccatccagattactatcaggcaactgttacatgtaactgcggtaacacatttgttacaggttcaacaaaggaagatatccacgttgagatctgctccaagtgccatccgttctacacaggccagcagaaagcagctcaggctcgcggacgtattgataagttcaataagaagtatggtatgcagcagcagtagtatgacgcgcgaagcgttatgctcctaagtgaaaacggttacagataaggttgaggttgtttaatctcaaccttttttaccttatagaatacggcacggttcgtgtgccacaagcagggtttttgactatgagatattcgggaattggcggtcaggcggtcatggaaggcgtaatgatgaagaatcaggaaaaatacgcggtagccgtgcgcaagccggaccaggagatcgtcgtcgagacttcgacgtacgaagggctgattaaaaataagaaaataagaaacatgccgatcttacgtggcgtgttcagttttatagaatcgctggtactggggatgaagacactgacgttctcggcgtcctttttcgaggaggaagaggaggaaaagagcgggtcccggaaagcggagaagcgtgccggagccaaaaagccggcgccgacggaagaggaacagaagaaaaaggaaaagcgtcaggagaatgcgctgatgggcggtacggtggcaatttccattgtgcttgcggtggcgatttttatggtgcttccttattacatatccgtattctttcagcgttttatcacatcgcagacgcttcttgcgttgttggaaggcgtgatccgccttaccatctttatcggatatgtggcggcaatttcactgatgccggatattaagcgtgtctatatgtatcatggcgcagagcacaaatgcatcaactgtattgaacaggggatggatcttacggtggagaatgtgcggaagagttcccgtctgcacaagcgctgcggaacaagctttctgctgattgtcatgctgatcagcatagtcttctttctgtttatccgcgtggataaccggatcctgcagcttctgctgcgcctggtgtcaattccggtgattgcgggggtatcgtacgagtttatccggcttgccggacgctcggatcatatgcttgtcaatctgttcagcaagccggggctcctgttgcagcggattacaaccagagagccggatgattcgatgattgaggtcggaattgcttctgttgaggcggtgtttgactggaaggcttatgtgaaagagatccgggaacaggcatgatggaggttggaaatgacgtatcgtgagacagtaaatctgggggagaaagttctgtccatggcagatattgcggaggcaaagaccgatgcatggtttttgctcgaaatggtgtgtaagatcgaccgcagtttttattatcttcatatggcagaggagatgccggaagagcagatgagcgagtaccagattgcgctgcgcaagcgcgcagagcatgtcccgctgcagtatattgtgggtgagacagaattcatgggactgaagttcaaagtaaattccagtgtcctcatcccaagacaggatacagagactctggtggaagaggcgctgaaggtcgtgcgccccggaatgcgtgtgctggatctgtgtaccgggtccggatgcgtgattgtcagtattctgcacaatgtatcggatgtggaggggtatgcggttgacatatccaagcaggcgctcaatgttgcgaaggaaaatgcaaggctcaatgatgtgccggtgttgtttgaacacagcgacctgtttgaccatgtgacggggacatttgatgtgatcgtctcgaatccgccgtatatctgtacggatgagattgcaaagctgatgccggaggtgcgggattttgagccgatggaagcgctggacggcaaggaggacggtctgtatttttacaggaagatcatcggacagtgtaagcagtatctgaacccggaaggacatctgttgtttgagatcggctacgatcaggggcaaaaggtgtctgcacttatgcgggagatcgggttccatgatgtgcaggtgataaaggatctggcgagaaaagaccgtgtggtgaccggaatgctttagttgattgcgggattggagagaattttgcatagttggtgcagacggttgtctggtgtttgagataagaaaggatgtttgttatgtttgataagttggatgatttactgattcgttttgaagaattgatgagcgagctcagtgagccggatgtcgcgaacaatccggagcgttttcgcaagctgatgaaggagcagagcgatctggcaccgattgttgctgcatataaggagtacaagcagtgcaagcagaatattgcggattccctcgctatgctggatgaggagtccgacgaggagatgcgtgagctagcgaaggaagaattaaacgatgccaaggcgcgtgtggaggagttggagcatgagttaaagattctgcttcttccaaaagatccgaatgatgataagaatgttatcgtggagatccgtgccggtgccggcggggacgaggcggcacttttcgctgcggagatttaccgtatgtatcagcattatgcagagagcaagaactggaagaccgagattgttgaggcggacgagaccggcatcggcggtatgaagagtgtgacctttatgatcaacggtcagggcgcatactccctgatgaagtatgagtccggtgtgcaccgcgtacagcgtgtgcctgagacggagtccggcggacgtatccacacctccacgatcagtgtggcggtaatgccggaagtggacgacgacattgatattgtcattgatgagaaggatatccgtatcgacgttatgcgtgcctccggaaacggtggacagtgtgtcaacacgaccgattctgcggtgcgtctgacccactacccgtccggtatcgtcgtgtacagccagacggagaagtcacagatccagaataaggcaaaagcgtttgctcttttaaaggcaaagctctacgatattgagcagcagcagcgccatgatgcagaggctgagatgcgccgcagccagatcggtaccggtgaccgttccgagaagatccgtacctacaacttcccacagggacgtgtgacggatcacagaatcaatcttaccctgtacaagctggataagatcatgaacggagacatccaggagatcatcgatgcatgtatcgcggcggaccaggcggcgaagcttgcgaagatgaatgagaactagaaaatgtaacagaaacggtctgtgacgcatgtcatggaccgttttttgccttgtcaggaaagctgtatttgttttttgttgtgttgttaggagtcctgtttttagtgccttgtcaggaaagctgtatttgtttttttgatgtcttgtcaggaacaatgagatgtccgggagtatgcacgggtctacagagacaaaatagccgtctgggacccgaaaatgccgataaaagcgggaagaaagcagcaaaaaacgaagtttttgggcacagggagctaaaattgttccgtgggacccgtaaatcggcgattttcgggtcccacagagcaaaaatcctgctgtagacctgtggcttgcgatagtgtcaaatgaccaatgaaaaaaccgagttaaagaaaaaggctcagatgaactttgaaaactgtagatattataggtagtggcagcttgccgccacccttgacagcacgaaaaagaaccgctgtaggtcgattaccgacggcgaagaacttaagaacagttgttttcttatgtcgattacagcagtgtagcagttctttttcgtgccatcaagggcaaaggcataaatgtcttgtcagaacctgtggttctgatggctgggttattacctttggctcttaatctaagaacagttagcggcttcgccgttttgtaagttcaggattgtttgttgaccgagaaagattagaagttgccattttccaggcatgtttgaagcaccatgtagcatctcaacatcattaagaaccttgtatttattgtgtttgtgagggcgaaggaagttatagtaagcaacccaaagcgctagatcatagttggctccgtctacgttgtcaaaaccgttggttggacgatagagagctttataagtgcgattaagtcgcgctatcatctgcttgaaagggcggtattctttagaaacttcatcgccgtttgtaagaccgataatcctggtgatatcaaatttaaaatcttctttgaactcacgataaaactgttgggcggcaagaggatatgcgctgtaaccattagcgataaatttgaaattttcaggaagcttggagacgtgtttgaaagccatacgcatcgaaagaatgcatgcaccaacgtcgcgctccgtagatatgcggtatccaagaaagggaacgactggcagcatccataataaaccagatgtatgctttaattccacggatttttatgtaggtttcatcggcagtaaagatttttcttgcattgtaatcgtagttgtctacgaatggtttgatgcagacagcaactgtcttacagaagttagctacctgttggtgggatatgtcaatgttgtaaagttcttttaaggcatattaggtcttacgaagagacattccaagatttacgtgcatggttaaacaaagccccattacattagaattgaacttggaaaatttaagagaggatgcatttttaggcagagaattaagatccatcttgaagaaatccaaggtgaattcacgatagatataatccattcatagaactggtcttaattaacgattgttgacgatacatattttgcaacttatctcctttggatgtggatatttattgtcaaaatatatatcggatcgaggtaagttgttttttatatgctccgcaacatcagcaaaatcaaggtctatgaattatgaaatttcttcagatataaaatagagaaacatacaatattattggtatccgaaaaaagtataatggagtgcttgataccagctttatttatttagatagagtcaggtaccggagttgactttgtcagtaaaaaaatagaaaaaatgcaaatacttatttgacatagtgaaaaaatactttataatataaagtatcagaagtgtataaaagatacaaaaacagatgagcaatgttgaggtattgtgacggatttgtcaaaataagtcacatggagaaaggagttacaaaatgggagaaattaaactgcaaatcaatccaaagaacagaccggcagtaccggcagtgaactggcagcaggcacgagtattagaaatgcaggaagagtatgcagctgcatttgatacatcgctggtaaacacgatcgaagagatgcgcgcagcatacaatgaagaaagaaagatgtggaacactggcggtcctgtgatggcagagacagttgactttgatgtgccgtatgaaggagataaagtaccggtacgtttacttcgtccggtgaaagcagagaaacttccggttatcttctttatgcacggtggtggatttgtagaaggaaataatgatacacacagtatggcacagagaaagcttgcagcttattcaggatgtgttgtgattggtattgactattcccttgcgccggaaattaaatatcctcgtgcgatcaaagaatgtgttgcagtatgccattatgtatcagagcatgcggatgaatatggaattgacccggagaaaattggatttgcaggagattccggcggagcaaatatggcgatgggagtctgcatgtgtttaagagatgaaggctttgatgtgtccaagattaaaggtaatatcttatactatggtggatatggcttaatgagtagtattagtagctatcagcatggcggaaagtgggatggaatgagtgaagctgatttatcttcaccatcttgttatattgctcctgatgtaaaccgttttgattgtccttatttccacatttatgcaaatgatcttacacatgatgtcccaccgtgtttccttgttgcagcagagcttgatccattaagagatgacagtaagttactttatgagattcttacaaataatggaattcaggctgaatatcatgaatataaaggagctcttcatgcatttatccactacagcaaagtaatggatgacgcagaagatgcattacgcagaggagctcacttctttgcacataactgtggattagatccaagaaatgaataaatgattacgtggtaattgcaattgcagggtactacgctagacggaaggctatcatattagagaatatgatagcctctttttgctttataggaaatttactctgtaatgttccaataaagcaaaaaacgctccgcgaggatgcgaccagatgcatgtggaatatgtctgctaaagcagaatgcatctggcgcgcaaagcgtaacaagtacctcaaagattaagggattcaggaatcttgaagcggacttgtccgctttgtttcacatgaatttacagaaaaaatattgcaaaacaaacgatttttttgaataattttgagccattttgctatcaaacaaaaataaaaataaatttagtgaaaaaatataaaaacaagtagaatagactgatatttgtttaacgattaaacataatgtactataataaaggtgtcgggagtgtgctgaaaatacaaatacagatgtttgatcggggaatttgtgctgtatttgttaaaaagaatgcacacggataaaggagctgcaaaatgggggaattaaattatcaatgaatcctatcaacaaaccggctgcaccggcagtaggttggcagcaggcaagagtacttgagatgcaggcagagtacgcagatgcatttgatactcagactggaagctacgatgaaatgtgtgcagcgtacggcgaagagagaaagatgtggaacagcggtggtcctgaaatggaagaaacgatcgaatatcagatcccttatgaaggatatacggttccggtacgtttacttcgtccggtaaaggcagagaaactgccggttattttctttatgcatggtggaggatttgtagaaggtgacaatgatacacatggtctggtacagagaaaacttgcggcttattccggatgtgttgtaattggtatcgattattttttggtaccggaagtaaggtatccggttgcgatagaagagtgtgttgcagtatgtaagtatgtaaacaccataaatttacatttacatattgaaaaaaccatttggtttcctttaatgtattagcgaccaagcaaatagaaaaaaggataacgcaaatggtttctgctaatacattatgcaagaatgttcttaatgtcaagaatacagtgatagaaaactttaatctttactctgatgaggatggcgtgaaacacatccgtatcaaagccagacatcatttttacataaaatatagttttcattattttataggattcgggtatcaaaataggaaggatattgtttttatttttttgataaaaaagacgaatgaaggcaacggatttggatgaaaaaagattgaaaaatgtggaaaaaatagtccgaggtacaaaaagtgatgcatttcatgaaaaaagacgggttgtttgacggtaaaacaaaagatagatgagaatttagaaaaacatacaaaaaatagcgatatttgtttgacaactgaacataatgagcttataataaggatataagaaatgtacaaaagatacaaatgcagatggaaaatcgggggggatttgtgctgtatttgtcaaaaggttgtatgttgaaaagtgtgtaaaaatttttatgtaaagagaaaggaagttacacgatgggggaatttagagtaacaattaatccaaaaaacaaaccagctacaccagaggtgaactggcagcaggcaagagtacttgagatgcaggcagaatatgcagcagcattcgatactcaggcaggaacttacgaggagatgcgtgcagcataccgcgaagagagaaagatgtggaacagcggcgggccagaaatggcagagacaatcgactttgagattccttttggtgaggataaagttccagcacgtttacttcgcccagtaaaagctgagaagcttccagttatcttctttatgcatggtggcggatttgtattaggtgataacgatacacacaatctggtacagagaaagcttgcagcttattccggatgtgttgttgtaggtattgaatatactttatcaccagaagtagtttatcctcgtgcgattgaggaatgtactacagcttgtaaatatgtattagagcatgcagaagagtacggcattgatccagaaaaatttggattcgcaggagattccggcggagcaaacctttctatgggcgttacaatgcacttacgtgatgatggatttgatatctctagaatcaaaggtaacattttattctacggatcttatggtatgaaagccagtgtcagcagcaaccttcacggtggaagctgggatggaatgagcgaggaagaccttgcattctacttggaaatttaccttggcgaaggcgtagatcctatagattgtccatactttgatacatttatcaatgaccttacacatgatgttccaccttgcttcatcgtttcggcagaacttgatccactgagagatgacagtaagttactttatgagattcttacaaacaacggaatccaggctgaataccatgagtacaaaggtgctcttcacgcatttatccactacagcaaagttatggatgacgcagaagatgcattacgcagaggagctcatttcttcgctcacaactgcggtttagatccaagaaattaatctacatacataaatcgatattcattccaagagggggtcactgtatttatacagcggctctttctttttgaaaatgctgatgtagagatgaaatagttatacggaatgttttaaagaactatgaatagaggactggggaaatttggcgtagggatttttgataagaaataaaaagcagaatgtttgatttgcaaacattctgcttttttggataaaatttacagccggggaggaacccggctgcagcgaaagaatatggtaaatatatattatataggaaaaagctttagtcacagaaaacatagtttctgagtcgatttaatgcttcttcaacacggctctttggaagagcaaggtttacacggattccatactcattatggaatggtcgtccatcctgccagtagacaccgacagactgtccttttttgtaaaggtcttctaatgtctggttgtgtgcagtacaccagcctttacagtcaaggaaaagcatataagtaccttctggttttgcagtatcaataccatcaatgttgctgaagaagtcatatgcgatattgacattttctgttaatacttcgcataattcgtctacccattcatgaccttccggcttataagcaccgatcaatgcgtgcatggataagacattcatgtcgttgtaatggcagagggaagattctttgtcgatgcgatccttcagccatgaattataaataatatgataagaaccgatcagaccggcaaggttgaatgtcttagatggtgcatataatgcaatggtacggttttttgcatcttcagacacagactgtgttggaatatgcttgtggccatttaagataaggtcagaccagatttcatcagaaataacaaatacatcatatttttggaagagttccattgctctttctatttcccaacgctcccatacacgaccggttgggttatgcggggtacagaaaacagcagcatggatatgattttctttgatcttacgctccatgtcttcatagtccatacgccaaaccccattttcatcgcgtacaagtggactcaggaccatattgtagccattatttgtcagactggctgtaaaaccaatgtatgtaggagaatgaaataaaacagaatcacccttcgagcataaaacacttaatgcgctgatcacgccgccgagaacaccgttttcatatccgatatgttcctcagataacccggttacaccgtttcttaacttatgccagttgataatggattcaaaatattcaggacgtgggcggaaatatccgaaagcagggtgcttcgtgcgctcgataatagcgtcctgtatcgttggtactgttgggaagttcatgtctgctacccacatcgggatcagatcaaagccttctttgatcggtgcaaatgagatccagctggcattcataggcggatttactgcaattgcatccatgccgtcgcggtttaaaatacttgtaaaatcatacttcatctaataggcctccttacgtttttacgtttgtgaatacattattttagctcttttttcttaatctttccggtagctgttcgcggaaagtcatctacaaactgccagaaagtaggaaccttaaatttggaaagccggtcactgcaatactgttctaattctgcaatcgtcaggctttctccatcggcaaactgaataaatgcttttactgcctggttgcggattggatccggaatgccgattacggcagcatcagcaatttttgggtgggaagtgagaacacattctacttccaggctgctgatattttcgccggatcgtttgatcatatttccccaacgatcgataaagaagagccagccggcttcgtctatatatcctctgtcaccggaatgaagccatccatctttgtccagaagacattctgtcgcacctgggtcattgtaatatcctggtgtaagagaacgacccggaataccgtggacacagatctcaccggttttacccggggcaacttcctttccgtcacagtcgatgatcttgatatcataagataaagcagcgcgccctacagaaggccagtttttatcaccggagatcggagaacaggtaacggcagaaatcgtttctgtcattccataggagttcagaagctgaacgtggaatcgacgttcgaattcatctttttcttctgtgcttaatcccatagaaaaatagacctgtttcagacaatgatcctgctcccatggttgtacaggctgcagcatcagtgtccggttcataatggacatggtatctgtaaagtttgcttttgtatcacagatctgtttccagaatttatgtgcgctgtaatgctctaccatgatcagtgtaccgccggcaacaatgacggacatagcagccatttcctgaaaatccatatggtaacatggcatacacgaaagaaaacggtctccggggcacatgccaatctgctgcatatggataataccaccatatacgacattgcagtgcgtatagatcacgcctttcgggtactgcgttgttccagaggtaaataggatgacggcagtatcctccggaagaatctcgcaggattcgtccagtcggctgccgtcaaaaaaactacttgctgaaagagagagaatgtccggatccggacattctccccaggctaaaataatggtagagagtagtaaatcttctttattggactgataaataggaagggaagacggctcaacgataatgcgatggatatcacatttctgaaggacgaatttgctttcctgcaggcgatagtgctcattcagcggaacggatacagcgccgatctgcgcaagtgcaagccagcacatcagatattctggtgaattgtgcagatgaagtgccaccagttcgcctttacggattcctagcgaatgaaaccagtttgctgtctgaataacacggtagtgaaattcagaataagtgtagctggtaagctggtcatcaactgaaatatattccagaaaattctgattaccataaaattgtacagtctcattccattgagaggaaagagtgcggttacctgcaatatcagtcatgatttctgcctttcattaggataatttttccgttaaaagtgggatgatcttatacatatctccaacaagtccaaagtcacagtttttgaaaataggtgcggacttatctttattgatagcaacgatcactttggatttgttgataccaccgatatgctgaacctgtccggatacaccagtacagatgataagatctggcttaacctgaacacctgtgattcccatgtaggaagattttggtaaccatttgttgttctcagcgattggacgggaacatccaacttcaccatcgatagcagaagccagcttctcacacatagcaagatcttcctgtgcagcaagtccacggccgacatcgacgatacgttttgcagcaacaaggtttacagctgtttcacgtttctcatctttagaaacacgttttaagcttgcggatgcagcaccggcgattggagcgatgtctgtgcaggcacctgttccttctgctgctgcgaagattccgctgtttacagtgaatacactgtaagctgtttcaatcacctgtttgttaacagctgttccaccgaatacagtacgctcgaagcatggtttaccgtcttcagaagtaagagaagagatggttgcgaacactgctgtgtttaagtaaacactgagttttcctgcaagagcacgtccaaggattgtatttccaacaagaacgcaggcagcatcagattttaaaatctcttctgcgatagcttttgcaaaatcttccggagaaccggattcttctaatggacatgtaagaatgtggtctgctccacactcagctgcagctgcaccatcaccgaaaacaacagctgtaacatcggaagcaacgtttcttgctccggcacagagttcggataataaagcattattttcactaattacataagattgcatatctaaaatcctcctttaagcctataaagcttctttcttaaggaaagcaactaaagcgtctactgcttcttcgttgtctccttcgataatttcctgacgtctctcctgctgttctggagcaagctgctcaagagtagatgcagaagcgtttaaatctgcaagatctgtagtaagaactgcaaccggttttttacctgcctgcatgatatcacgcatagctggaacagtcggaacgttgatctcagatgaaacggaaagaactgctggaagtgctacttcaaaaacttcagtgctgttctcaagagtacgctcaacaagaacggtatcaccgtttggctggatggaagttacgttgtttaaggttggccagtcaagtaatgtaccaagctggatacctgttacctgattgtagagatcggaagaaccggttccgcaaagaacgaggtcaacttcttcctgctcacggattgctgctgcaagagcttttgctgtttcaaaagaatcagagaagctgtgatcgtcgctgatcacaagttttaaatcatttgcaccacgggaaaggatatctttacggatctttgttgcatcaagagctttggaagaaccaacgcttaatgcggtaacggaaccctttgtctctgcagaaagcttctttgctgcttcaagggcgtttaagtcatactgactgatttttgctggtacatcatcaagagccagctctctgttaggaagaactttgatctgttcttcatccggtactactttacaacatgtaataattttcatttgctcacctgctcctaaaattattttttgtggtgttttaaactgtttcaatcatagaaatagaagatacaataccatgcgtcgtctcaaattgtcttgaattgtttaaaaattgtatggtaaaaaaacaattttgaaaaatgaaacaaatttaaaacgggacaaaatgttaaatttgtaagcttatcttattatgaataaagcgcggtgtcaacaataaaactgtaaataattgaaaaaaatatcgaaaaaaaataaaaaaaagcttgcaatttattcaaaataacgaaataatagaagtatgataaaaataaaacgaaatgtttgaaacgaaaatgaattgttcggacgtcaaacaaaacaggaggaggttatcatgaaacctttggaagcagtatcggtattggatctcactgagggaaacccgtatatcggaagcgtgtttgcagattacggggcaacagtacttaaggtggaaaagccacagggcggcgatgatatccggcgccggggaggaacaccggaggaagaaggaccatatgcacagtactatctgcgcggcaagaagagtattgcaattgattacacaacagcagacggtcaggagatcgtaagaaagcttgcagcaaaatgtgatatggtagcggtaaataaacaggaagattatatggaaagactcggattggggtacgagaacttaaaagcagtgaatccgaagcttatttacggagtgttaacaccatttggtaaagaaggaccatggaaagattgtcctgactatgacctgatcgttatggcaaaatgcggactgcttgagaagaccggttttccggagagaccgacaaagtttggtttcccactggcttacatttatgcaagctggcatctcacagccggaatgatggctgcatatctgaaagcagaagagagcggcgagggcagtaaagtttccgtaagctcatggcatacgatgatggagcttgatgatacttttgcagaatgtatgcagggactgaatgtgttacctagacgtctcggcaacggattcccgacaacgaacccgactgacacattccactgtaaggacggctggttcgctttaagtatcggaagcgataaacagtggcttgactttgcaagagaggccggcagggatgactggggagagggaagcgtatatgcacacgacccggatcgttccatgaagcattacttcggagaacttgaccagcagttaaaagactattttgcaacgatctcaattgatgaagcagatcagatctgccgcagggcaatggtacctggcggaccttgcaatacagtagaagagctgatgaaggatgaacaggttgcagaccgtggaatgatgatcacggtaggcggagagacacagatcggaattccggcgaagttctccggtgcggatgatcttgataacatagaacctggtcatgtgcttggtgcagatacgcaggcagttctgacagaatacggtgtagaataaggagagtcaaaggctatgggaacagagaacagaaagggaccattgaaagatgtaaaagtgcttgattttacgattgcacttgcaggtgtatatgtggcatggcagtttgcagatatgggagctgaagtctggaaagtagagcgctacggcagcggcgaccaggcaagaacatgggatccattcgtaaacggattaagtactctttatacagcatataataagaataagcagagcattgagctggatctgtcttctcaggaaggcaaacaggtcatctacgatatggtaaaggaagcagatgtcgtacttgaaaacttcaagagcggttccattgacagactgggacttggatacgaagaactgaaaaagatcaatccaaagatcgtgttcgtatcactgagcggattcggagcgacaggacctctgaaaaaatatccatgttatgatgcaatcgcagcagcccgcggcggatttgcaggaagcaacggagaaccggacggtgcaccaatgaaagcaggaaatgcaaattgtgataccttaaccggaacacacgcattaaacgcagcgctgatcggcctgatccaggcacgtaagacaggagagggatgcagagttgatatcggtatgatggatacggtaatgatctcctgtggtgagactgttgtcgattacggaaaaggaacttatacacagtcaagattcggtaatcatgaccgcttcaccgcaccatacggaattttcgaagcaagagacggctgggcagttatcattgcagacagcgaggaacgctgggcaaagatgtgtgatgcattagatgccggacacttaaaagacgatccaagatttgcagataacgcggcaagaatcgcaaacagggacagcctggtagaagaacttgaaaaagtaaccgttacttataaacggagcgagatagaaaaacgcctgacagaagccggggtaccggcatctgaagtacttccttttattgaagcatatacttcagaacatgcaaattcaacagagacgacaacacttgttgatcaggaaaagattggacagatgagattctataacaatccgatccggttcaacgacgagttatgcccgatctggagaggagcaccacttcttggcgaagacagcagagagattcttgcaggacttggatacagcgaagaaaagattgaccagctctttgcagacggtgttgtcggaagcagcatgatttaatcttggatcacagatagaatacaggttttgcgtaggaggaaagatgcagataatcagagtcccggtaggggcatttatcacaaactgttatattgcagaaggacaggaaccgggaagaggatttctcgttgatcctgcagataatccgaaaaagctgatctccatcctggaggaaaagcagatctgtccggaagcaattcttctgacacatggtcattacgatcatattcttgcggtaccgaagctgcaggaacgatggaaagagattccggtgtattgcaatgcaaaggatattccggagagtcttacggagtatgatatgggacagcagttcccgacagtcagggcatttaagaatgtgaagacgatcgaagatggacaggagctggtgatcgcaggaacagagatcactgtgatggaaacaccgggacatacgccgggatccgttctgtttctgacaaaggatgcaatctttaccggagatacgattttccagggaagtatcggaagaacggactttgaaggtggaaatgagcgccagatgatgcagagcctgagaaaaattaatcatcttgccatagaggacattaccctatgtcccggacatggcgacacaaccacattgaagtgggaaagagcacataacagctatctgaagatgtgcagatagctgtaaatgatagaaaaaatgaggtgacaattatgggggaaacaaagaaagtacttactgaactgaaaaatggcgtattgatcgtaacaatcaaccgtgaagagcgccgcaatgcaatcgacccggaaacatccgcaatgatggaacagatcttaaacgatgctgaacagaatccggaagttggcgcgatcattatcacaggaacaggcgacagaagcttctgttccggagaagatttagcagcttatgatgaaaacggaacctgtcagacaattatggcacatggatttgcaggaatcacagaacgtctttccgcaaaaccgatcatctgtgcagcaaacggaactgcagtagcaggaggtcttgagatcgcacttgcatgtgacattatcgttgcatctgagaatgcaagattcggactttctgaagtaaaagtcggattcctggcaacaagcggaggactgatccgtttaccaaacatcattcctaagaagatcgcatctgagatggttctgacaggaaaactgatcgatgcacagcgtgcttacgaggtaggtcttgttaactatgttgttccaagagaacaggttatggacaaagcaatggaattagcagagatcatcgctgcaaacgcaccgatctcattaaaactcagcaaagagattttccatgtagcaacacagtgctctttcgaagatgcacagagatattgcaatcgctgctgggattacatcgagaaaacagaagatgcagtagaaggaccaaaagcgttcttagagaaacgcaaaccggactggaaaggcagataataacaagtgtttggcatggaatgaaaaaagaaaccatgtaaaatataattaagaaaaataatggaggaaataatatggatttcagaattacagaagaacaggaattaatggtacaggcaatcgaagaggctatgacaagagaaaatcttgagccttacttccaggactgtgacaaaaaccacacacatccagagaaatggtgggaaatcttaaaagagctcggatgctttagtatgttcttaccagaagaagctgaaggagaagacggagaaccaggtggcggcgaaggcgcagttacaatgttcctcgtaatggaagctttaggacgctgtggcgcaccaatctaccttttctgggatcatgtaaaagctgatgcacttttagagaatggaacaaaagagcagatcgataaattcatgcctttattcttcaaaggaaacggagcattcgcacagggattctcagaaccaactgcaggtactgaattatccagcaatacaatccttacaacttatacacgtcgtaacggaaaagtatacatcaatggacacaaacatttcatttccggagcacaggacaatgattactgtctgacacttgctaaaaacagcgagaatccagaacagcttacattatggtttgttcctacaaacgttccaggctgcaagaaagagccaatggaaaaaatgggattaaacatggaaaacgtaaacgacatctggtttgatgatgttgagatcgaagaaagcgatatgttcagcttcgaaggaaacggattaatggcaacatccaaaggttttgattacgagcgtctgatcgatgcattcaacgcatatggacaggcattatgtgcatacgaagatgcatgcagatacgcaaaccagagaatcgtaaaaggtcaggagatcggacgtttacagctgatccagaaccatatcatggaaatgaccatgaagatcgaagctatgagaaatatgcttcttcactacgcatggaacaaagataacaactgcctgacaagagcagaggcatctattgcaaaacagttctgttctgaatctgcaaatgatatcgctgaccatgcactccaggtaatgggcggaatcggatactgcggaagccgcgtaagccgtatttatagagacttaagaatcacacgtatttccggtggaacaggtgagattcagacagttattgcaagccgtcaggtattaaagaaatataaataaagagagaggaatggaggatatttgcaatgaagaatattcttgtctgcattaagcaggtaccggatacgacagaaatccgtatcgatccggtaaagaaaacactgattcgcgaaggagtaccaagtattgtcaatccatttgatgcatacgcattggaactcgcagcaagaatcaaagataaagaaccaggtacgaaaattacattagtatctatgggaccaccacaggcagagaatgctttaagagagtgtcttgctgtaggcggagacaaagcataccttgtcagcggaagagaatttggaggaagtgatacacttgcaacaagttacattctttcctgcgcaattaagaaattagaagaattagaaggaaaattcgacatcatcttctgtggaaaacaggcaattgatggtgatacagcacaggttggacctgaaatcgctgagcatatcggacttccacaggtaacatatgcgatcgaagcagaagctgaggaagacagacttgtgatcaagaaagaagtagaagccggatttgaaaaggttgcagtttcttacccatgtctgatcaccgtaacaaaaccatccttcgatcctagattccctaccatcaaatccaagatggctgcaaagaaagcagagatcaatgttctcgcctatgcagacttagaagctggtatggataatgagagaatcggattaaaaggttctccaacaaaggttaagaaaacatttaccccagaagtaaaaacttcaggtgtgaagatcaatgaaccgacatcagaagaaggcgcagaaaaattatttgccattctctgcgaagataaagtattttaaggaggtgaaaagagatggcggtagaaaagacaaaggatctttgggtctttatcgaaacagaggatgaaggtactgcgaaaagcgtaggacttgagttactcgttccaggtagaagacttgcagataaacagaacggaaaacttgttgcagtaattttaggaagcaatgttgcaccagcactcgaagctgtaaaagcacacggcgctgacgaagcaatcgttgtggatcagcctgaattaaagcactataacacagatgcttatgcaaaagttctttgcgaactgatcgaaaaatacggaccatccgtaatgctgatcggtgctacaaataacggaagagacatcggacctcgtatttcctgcagacttggaactggtttaacagcagactgtacagcattagatattgatgatgagacaggcaacatggcatggacaagacctgcattcggtggaaacctgatggcaacaattatgtgtcctgaccacagaccacagcttggaacagtcagacctggcgtattcaagaagagtgaaccaggtgaagtaaaagacattccggtgatcaaagaaaaagttgagatcacagatgcagaaaaacgtgtagagttactcgaagtgatcaatgagatggcaggggaactcgttgatctggaaaacgcagaaatcatcgtttccggtggacgtggagtaggcggaccagaaggttttgcacctgtaagagagcttgcagaagtattaggtgctacagtaggagcatccagagcagctgttgatgcaggatggatcccacatgcacaccaggtaggccagactggtaaaacagttggaccaaagatctacattgcctgcggaatttccggagcaattcagcatcttgccggtatgagcagctctgacgtgatcattgcaatcaacaaagatccagatgcaccaattttcaatgtggctgattacggtcttgttggagacctgaaagtagttctgccaattctgacagaaaagatcagaaaatacaaagggttataagaagtagccagaggttttttgattaaaaaagtaagagaagagaggtaaaacactatggaatttaaattaaatgaagaccagcagttaatgaaagacatgttcgttgaatttacagagcagtttgtcaaaccaatcgctgcagagttagatgagcaggagcgcttcccggaagaactgattccacagcttggagaaacaggacttctcggaatcccggtcgctgaagagtacggcggagcaggtgcagacaatatgtcttacgttcttgcagtagaagaagtttctaaagcatgcgcaagcacaggtgttacaatttcagctcatacatctttatgctgctggccaatcgaagcattcggaacagaagaacagaaacagaaataccttccagatcttgcatctggtgaaaaacttggtgctttcggtcttactgagccgggcgctggatctgacgctgctggacagagaacagttgcagaagacaaaggcgatcactacttattaaacggaagcaagatcttcatcacaaacggtgaagttgctgatgtttacgttgtatttgcaatgacaaacaaagaacttggaaacaaaggaatcagtgctttcatcgtagaaaaaggatgggaaggattcagctttggaagtcatgagaagaaaatgggtatccgtggatcttctacatgcgagctgattttcgaaaacgtaaaagttccgaaggaaaaccttttgggagaagttaacaaaggattcaagattgctatggcaactcttgatggcggacgtatcggtatcgctgcacaggcacttggtattgctgaaggcgcattagacgcagctgtagaatatgttaagacaagagaacagtttggacgtcctatcgcagcattccagaatacaaaattcacacttgctgatatgaagacaagagtagaagctgctagataccttgtatatagcgctgcttgtgcaaaagataacggcgaaccatactctgacaaagctgctatggctaaattattcgcttctgaaacagcaagagaagttacctggagagcagtacagttattcggtggatatggatatacaagagattatccagtagaaagaatgatgcgtgacgctaagatcacagaaatctatgaaggcacttctgagatccagaagatggtaattgcaggaaatttgctgaaatagtttctggagacagaaatggaggatgatacgatgggagaaatactattttcagtcgtagttggaggctgtctgatcgcttcaggaatccttatgattttcgtccttgggaaagaggaaaaaaaggttagaaaagataaggaggatgttgcatgaatatattctttataggagtggttgtcagcatactggtttacatagtggttggaatctgggcaggtcgttctgtaaaggacgtaaatgactattatgtcagtggaagaaatgccccgacgattttgatcgccggaaccctgtttgcatcgatgctttcggtaaacgggttcatgggagaccagggatggtgctattccggcaacattacaacactggtattgctaaattccatgtgtgcaatgggttatattgccggaccacttatgttcggacgatatttaaggcggtcagaatgtacaacaatgccggaatatttcggagcgcgttactgcgatctgaaaaaccggagagttgccggaattattacagcagtttccctcacagcgtatttgctctcatgtatcaccggagttggaattttaatgcaggaactgacagggctttcttatgagctctgtctcttcctggcatggttttgttttaccgcttttactttttattccggttcgaaaggagttattcttacggatacgatgatgttcatggtatttttaatagcgacgatcattgccggtccttatgttttcaaggcacagggtggaattggtcatctgctggagaatctcatgaataatccaaacattccggagaaccttttggattatcatggcaatattccaggagccggggcaacagatgtttttggtgcagtgatgtatgcagtgacgatgggaattatctggtttattacagtgtcggtatcgccttggcaggcaggacgtaacatgatggcaaagagcgagcatgttacattccgcgcaggtgcgatcgcagcggcatgtacggtgattttcctgatgtatttgaatctgcagtctgtgaccgtactgaatcttaaccctggaatggaagatccgcagagagttctgatctgggcagcatttcatgtaatgccgaagttcgtcggaacattgatgcttgccggcattatggcagcaggattatcttctgcatccacattcctgtcggtcattggattttctattacatcggatattgtttttgtggaatttaaaagtgaaaagcagcagttatttgtcagcagagtgataatgctgatcctcggtgcgatttccttactgttagcatatacaggaatcggaagtgtccgcatcgttacttattttgcatctacgatcatcgcagcaagctggggcgtttccgccatcggaagtgtggtaagtaaaaagctttccgctaccggagcgagatggtctatgatcgccggatttgttggattcattgttacaaaatgtctggttggatttcatgtaggattatttgcaactgtatttattaactttttagacccattctttattggaatttacctgagcctcttttttgcgatactcggatcaaaattacatccggtgacagaggaggaaaaagcatatcgggaaaaacttctgatattaccggagtctgaaaaggtaataaaagattacaagatcgacaaagtatttggatatcttctgatcgcagcaggaattgcagtgacactcttccttttattcggctgggcgctgccatataacggaatcatataaaataatgatagagaaaacgtggaggggaaacgttatgacacaaaaatcaaaaagcagtaaagtagttactctgattcttatgatcctggcaatgaataccatttatatgttgccatacctgatgtatacatactatacaccattacaggaggctatgggtcttattggaagagatgctgactatggtagattattaaacgtatatggtattgcaaacgttattttatacctgccaggtggatgggtagcagataaatttgactgcaagaagttacttgtattttccatggtttcaacaggtgttcttggtctctgggaagcaacattcccaagctacacaatcctgttactgatccatatattatttgcagtaacaaccgtacttacattctggtcttcttctgtaaaatgtgtcaacatgctcgctgatgagggagaacagggtggtatgttcggaagcctggaagcaggacgtggtgtttcaggtctggttcttactattatctttacatctatttatgcagtaaatgcagctgacagcacaaaggcaatgagattaaatgtgtcaattatctcagttgttatgatcgtgatcggtattcttttagcagttttaatgccgaagccaaagaatacagaaaatgcaacaaatgctacattacttgacagtatcaaagcgatgggtgttgcattcaagtgtccagttacttatctgttagcaggtatgatcttctgtggatctatgtgtcttgcatctacaacttattttgcaccatacttacagaacatttgtggattaccggtaaaaatcggtgttttatattcaaactacagcaagatcgttacacagttaatcgctgcatctgcagctggtattttagcaactaaattaaaacgttccacaaaacctatgatcgtagccggtgttgttggagcaggtttatatattgttatggaaatcttaccagcatctacagcagttatgtggccaatgcttgttgtaatgacagttgctcttatgatgatctatgtattccgtgctctgtattacgcaacagtagatgaggaaggaacacctaagaacatcgttggtagtgttatcggtatctcatccttaatcggattcattccggatacattctacacatcattatgtggtaaatggctggaagctgatcctgtaggtggatacaaaaagatcttcttaagctgtattttggctatggtaattggtcttgtttgtgcatttatttccgatagaagaatcgtaaaattccgcgcagcaaacaacaaagaagcttaattaataagaaaaagattagtgtgttgaaagaataattcaagcgttgatacgttgaataaaaaaagacagagtgtcctaaaattggatactctgtcttttttcatgattcggatatggagggtcaaaacgtttgttttataaacttaaatgcaaacgttttgacaccctactctgattcggtaaataaatgtcagaaaaaacttcctgtttttggggagaaaaaagagagatataaaaaccttgtgtttttaaatatctctctgctaggattcttcatcaaaagcttttgacaataatttaacatattcatgtaagactttacaaaaagaattcatttcactgatagagcagacctttaatagttctgactgtatctctgttgttttttttgtgacaaaagcgatataaagggtattcagacgttcaccgtccggagtagtgtatagatgcactacttttgcattaccgggacgcttttcgcggtaaatgtagccacctttttctaggttggaaacaatggatgaaatagttccttttgtccgatgttgtttttgggataaatcacttacggtaatccctggattttgttcaatcgtagataagatagcgacttcgacagatttgatcggacgatcattaccgtagtcacgagttccattttgcatatctgtgaacagcatagcgaacatggaaagatcactggcataggcgatgagattcgtactatccttatcccctgtattgtaatattgtaccatgtatgcggtacctccttgaatgattgcatatcagaataataatgatatatatatgtaatatatcatgagaaaataggaatgacaaggaaaaacggggaaaaacagggaaaaggacagaaaaacatttctatacaagaattaattccaggatcaatacaaccgtacagcagccgacagatacttgaaacagacttgcgccaaaccatgcaccgatcatcccaaaaacgagtgcgatagcacctgcaacaggactttgtgttgcttcgatgatcgcaggaaaagtcatgacggataacgtaatatatggaacataatataagaaagactggataaattgatttttgatcggttttcggataagagtcagaggaagcacacgggtcgtgtaagatacaagtgccatgacagcaatataaaaataagggttgtgtgtcataaaaaaactcctttcgatagtgaagacagagtgaaatatatgtaatgtttcaatttaggtagttgcatttttatctttttccggggtgaccgggaataggatcgcagcagcagaagacaggatcaccgtcaaaagaatggtccttgttccacttgaaagagaacgggttcagatagccggggcgtgcaattgtgatcccaaacagcttgtcggtcacatcataggcgataaaaagccgatggataaaaggggtgtcttccgagaagcgttgtgcaagtgcacagctcatcaaaagataacgggcattggagattagcgtgatgatcgcaacttcaagataagtggcatttgctgcgatcagtgtaaaagcagcatattcacctgctgaggcgttattgaggaggctggcaagaaatccctgtaaaggattcagaccggcattccttgtggcgattccaagagaaaaggataccgcaaaataaccgagtgcgatcggaaatccgtcccgcattccttcggtgaaaactttccggctgaaagtatagaccggatgttggcttgttttgaatgtctgtatattgtgattcataaaaattctcttttcatcaggttgttaatatcaaattaactatgtggaagagatgatggggaaatttgaaaaagataccggaacaggcagatttttcaaagattttaagaaatatcatgggcttccggttcaggatgccattttctttaaccagagtgatctgatctgtgatatggcaaagcacgaggactttattgttatgggaagatgtgcggacgttgtactcacgaatcatcatatcccacatatcagtattttcatcacagcatcgtttgatcagagtgtacgccgtatgatggaaataaacagcttaaactacaagcaagcggaacacctgttaaagaagttagataaacgccatgaacgttattatcatgcatacaccggtaaaaaatggggtgatgcggtcaactatgatctgtgtattgacagtgcaagttacggaatcaaggaatcggttgagctgatcgagcgtatgatcaataagtatccgaatagttaaaaaataatttcatatatgtaaacacattgcacaaaaagtagtgttttttttctacactttagactctaaaatatattgactttagtttctaaaacgagtatgcttttattaagataaaaaatatttcatttaaggagaaaaaagtatggcaaacaaagaaatcaaaacagagcaggcaccggcagcaattggtccatattcacaggggatttcagctgaaaacatcgcatttgtatcaggacagctcccaatcgatcctgcaacaggagagtttgcaggtaacgacattgcaagccagacacgtcagtccctgaaaaatgtgcaggcaattttagcagagaatggtatgacgatggcagatgtgacaaagacaacagtacttcttgctgatatcgcagaatttgcggaaatgaatcaggtttatgcagaattttttgcagaaccatttccagcacgtgcagcatttgaagtagcagctttaccaaaaaatgcgaaagttgagattgaggcaattgcagtaaaaagataagaggaaaatgaagatgagcgtagattttaaccgtgaggtcgatcgtagaagtacaagtgatgtgaaatggcgcccggaaggattaaaggggtatcttccgatagaagtttcggaaaatgagatcccgatgtggatcgcagacatggattttgcatgcccggagtgcatcgtaagagccatcaaagaaagagccgataaagagatttttggttattgctcttataagcaagagtattatgatgcattaacctggtggtttgataagcgatttggaatgaagatccatacggaccttgtttccatgatgccgaccgttgtcagtgcgatcaatgttgcaatccgtgcattcagtaatccgggagataaagttattattcagcaacctgtatacgatccatttgcagaactgatcaagaaaacaggaagagtaatggtgaacaatggcctgatctgtaatgatggactatatgagatggatttcccactgcttgaagaacaggcagcagatccggatgcgaagattatgattttatgtagcccacataatccggtgggaagagtctggacaaaagaggaacttgcccgtgtcggtgagatctgtaaaaagaacaatgtccttgtgatcgcggatgaaatccacagtgatcttgtatatgcaggatatgttcacacaccgtttgcgctggcaagtgatgcaccgcatctgttgtgcacatctcttggaaaaacctttaatgtagcaggacttcgccttgcgaatattttcagctcttcagcagaactgaaaaaacagtatgatcaggagattgatgcttattcatacagcgcatccaatacgtttggtttggagatggtacaggcggcatattcaccggaaggagaggcatggctggaagaattattagtttaccttcagggaaatgtggaggttgtttcagagtggtgtcaaaagcataatgtaggatttacagcaccgcagggtacatttttatgctggctggatcttggcagtgccggactgacagacgaagagattattaagaagattattatgggaaaagaagtgatctgtgtaccgggaccatggtttggcaaaggcggcgaaggtcatttaaggctgaatattggctgtacaagaaaaacgctggtagaggctctggatcggatcgcttctgtattaaataactaatttcagaaaagcacataaatgcagctttgtagaacaaaaggaggagggtttttatgctgacgaatgaaataatccgcctgcaggcagaagcacagcaggattatgtgattgaaagccgacgtaccattcatcgttttgctgaagtaagcggtaaggaattcaagacaagtgcttttattgaagaagagattaaaaaagccggtctgccttatgaaaaagccggtgataccggttggatcgcaattcttgacacagggaagccaggatcacgtattgcgctccgggcagatattgatgcgcttctggtaccggaggagccaaataaccttgcaggtcctcgtgttgtagtgtccgatgacccacatacgagtcatgcatgtggtcatgatgcccatacagcaatgttattaggagctatgcgtgttcttgcagagcaacgtgataatctgacaggcgtgatctatttctgctttgaagaaggagaagaggatggcagaggaatattggctatgttaaatcaactcagcgcccatggtgtggacgtttgctggggaatccatgtttatgcaggacttgaatccggaaagatttgtgttagtgccggtccacgaatggctggtgctgcgggagtcggcattaaggttatcggcagagggggacatggctccagaccggatatgtcggtaaatcctgtattttgtgcagcctctattctgaccaatacagcgacggcctgggtcaatcagattactgccggaagaacggttacgttaggtgtgaccagtatccagggtggtgaagcaccaaatgtcatcccggacacagcggatatacttggttccctgcgtttcttcaatgatgaagaaggagaaaaagctgtccgaatctttaagaatgtagcagagcatacggccgcaatgaataattgtcaggtacaatttgatgatcgtttctgtgttttatgtgcgccagtgatcaacgatgagtattattcaaatcttatttccactgcattgccggaggtacttccggagaacgtaacggtttcctcttgtgagccatggtatgcatcggagtcattctcctgctatcgaagaatttgtccgagtgtactggcacaccttggaattaataatccgtcctacggttcgggtgcagcacatcataatggtttctttgatgtggatgaaggagtattatctaccggtgtgatctctacactgaagtttgttgcaatgctgcaaaaataaaaaatcatacgcagcaaaatagcaagtgctttactgctgaatgaacattaacttactgccgtaaaatgtttccttgcaatttttggaattgtctgcaataattctatatgcggaggggatagagatgaaggaacagcgtatcaaattaatcggaaagttattacatcagcagggaaatacagcaagagcttttgtacagtatatggattcagaccgtgagtatacggcaggtgataaactctacatgagagaggcacactttgtgatcgcgatcggtcccggtgaaggacgtactatgtctgagattgccagagagatgaatgttacacagggggcagtttcgcagatcgcatcacgtctggagaagaaaggatacgtctgtcgcaggaagaatgaagaaaacaaacggcagatcattgcgtttctgactgaaaagggagagcagttttacacagagcaccagcgatacgacgaaagtatgcacaggcagatggatgagatcgccctgaacaggttcaatgaggaagaactacagtgcatctttgaatatgaacagatcatggaaatgttgctgaaagaagaagcgcttacgcggcatttgacagagaaaagtaaaaattaaaaattttgaagaaaacgaaaaagagccggatatctgaattttgagatttaatctcataggatatggaaggctctttttttatgaaaggattcgggtgtcaaaagatttgcatttaagtttatactggcagattgcacaaaaaatattccaagtttcattgtgcaaaacattccgctaagcaactcaaaatgataagcagatttcaaaatctatcaaaagatttttacgagatttcatgtttcttcagctttgaaagcgtccaatgcctacaaaaagaaaggcgttccagtaatggaaattttccagtatctgtttctgctgattttttctaacagaagcatgtacatgaacctgatcacacgacggaacactcctgattttgcgaaggatactgtatatcgttttatgaaaatgattcagattaactggatccgtttcacaacaatactttcaacccgaatcatcaaggatgccattcttcctttgaattctgaggatcgtgcaaatgttcttatcattgatgattgccagactgaacttcagacagcaggagccgactcatattatggagaacattgtttataatgagctgcttgtgcgtggttacaatgtggatgtcggtattgtggatgtatttgcaaagaatagtgagggaaagagggttcataagcagttagaggttgattttgtagtgaaccaggggagtcagagatattatattcaggtagcttatgatatgacttctgaggagaagcagacacaggaacttaattcactccgtaatattccggattcatttaagaagattattatagtaaatggaacaaaaaagccttggagaaatgaggaaggatttgtaatcatgggcatgaaatattttctgcttaatgcagatagcttggggttttagtttggaaggagataatatattccgattatagaagatatggatataaagttaaatccgattttccgggagacttacacgcttggggatgtcggtgtaaaggagaagggatatacatcacggaagcctgcatgggatgcgacgcctgcgcggcagtatgtccgcagcggtgcattgaggagggcgcgccgtaccggattcatcggaatcattgcttccgttgcgggaactgctgtgagaactgtccctcgcacgcgattgagcgaaaatgagaaaaaacgattagtcgtacatatcacgaaaaaatgaaaatgccagaaaattcatgcttaaatgataaaaaatgcgaataataataaaaaatgttttcattgactaacagatattgaggtacttacaatgggaacaaaaggagggggtttttatgtatgcattgtcaaaagcacaggcaggagatatatgtacgatcaagtggatgttcgggctgccggaggcagtcgattttctgcgccagcatcacgtggaggagggagagaccatacaggtcatccgtaagctgcgggacagtctgatcataggggtgcagaatgagcgggtggcgcttggaaaagaaatcgcagaccgcatacaggtttaaaaagaaggagggcagagcacttgttgcgctgctctcctttttgtgtaataggaacgaagtttcctattacataaaaaagtctgtcttctggcaagaaaactggtcataccagattccagatggcagattgcacaaaaacagaaccgtaaatatagtgcaaaatagcgttgatttcacagaaaaagtgtgttaaaatttagacaaacatgaggtatgaccagaacgcaaccgaacaaaggaatacctcggcacagggaaaggggcatacgaatgagtgagtttaaggtgattgaaatcaagaagaacattctggaagacaatgacagagaagcagatgtgcttcgttctgagttaaaggcagacagaacatttcttctgaatctgatgtcttcaccggggtctggaaagacgaccacgctggtgcggacgataggcgcgttaaaagacgagatgcgcattggagtcatggaggcggatatcgattcggatgtggatgccgacacgatcgcacagactggcgcgaaggcaatccagatccatacgggtggcatgtgccatctggatgcggacatgacgagacagggcattgagagcctcgagacaaaggacgtggatctcgccattctcgagaacgtcggcaatctggtctgccctgcagagttcgatacgggagccgtaaagaacgccatgatcttaagcgttccggaaggggatgacaagccgttaaaatatccgttaatgttttccatctgcgacgtgcttttgatcaacaagatcgatgtacttccatactttgattttgacatcgaggcatgcaaagagcgcgtgaagaagctgaacccgaacattcagatcattccgatctcttcccgcaccggcgaggggatggatgcgtggtacgactggcttcgcacggaagtaaaacagtggaataattaaaaactgccggaagcggcatacatattttatgggtatacacaggctatgagtatgcgcactcttagagtgcgcactatttatgcaaatataagacgaaaacagacgagacagaataaaaaaacaggaaaaacaacgaaaaacgaaggaaaaaggagactgttatggcagaagaaagagaactgattttaaagctcgggaaaaagattaccgaccgtattccgtacaagcttggtatggagaagctcacggtaaacgatccggaatactggggtcttgcaggtgtggttaccgatgagatggcggaagtggcactgtgcatggacgtgcgcaagccgattacccttccgaagctggcaaagaagaccaagaagccggaggcagagcttgagaagctgctgcaggagatggcggttgtcggaatcatcgagtacaactgggagaatccgcagcatgagaagcagtacattctgccgatgtatgtaccgggaagcgccgagttcatggtaatgaacaaagagcaggtggaaaagcacacagaggtcgctgatttctttgagaatatgtcaagacttccgttagagaaggtgacaccgatggtgccgctcggcggagccggtatcggtatgcatgttatcccggtagagaaggcaattccggcagcgcaggaatctgcagatgtggaacacatttcccactggctgaaaaaatacaaggacaagtatgcgatcgggcagtgttcctgccgtctgcagcagagagtccgcggagagggaaccggcgatatcgagggcgagtggtgcatcggtgtcggcgatatggcagacttcctggtacagaccggaagaggacactatgtggagcttgacgaagtgttagagcttttagagcgcgccgagaagatgggttatgtacatcagattaccaatatcgacggcgaggataagatttttgcaatctgcaactgtgcagtcggcgtctgcaacgcgctgcgcacctcccagctgttcaatacaccgaacatgtcccgctctgcataccgcgcacatgtgaccaaggaaaactgtgtggcatgcggccgctgcgtggagtattgtccgaccggtgctgcaaagctcggacagaagctgtgcacaaagaacggtgagatcacttatccgaagcaggagcttccggatgcgacaaagtggggaccggagaagtggagcacagattaccgtgacaagaaccagatcaactgctatgagaccggtacagctccgtgtaagactgcctgtccggcacacgttccagtacagggttatgtgaagatggcagcggaaggcagatacatggatgccttaaagctgatcaagaacgagaatccgttcccggcagtctgtggttctatctgtaaccgccgctgtgaggatgcatgtaccagaggaacgatcgatcaggcggtagccatcgatgagatcaagaaattcatcgcagagcaggagatgcatgcggataagcgctatatcccggagattgtcaaccatcttggaaccggcgtggatctgccgcagaagattgcgattgtcggcggcggcccggctggtctttccgcagcgttctactgcagaaagatgggttatccggtaacggtattcgagaaagagtctcgtccgggcggtatgctgttaaacggtattccgtcgttccgtctggagaaaaatatcattgacgcagagatcgaggttctccgccagatgggcgttaccttcaagtgcggcgtagaggtaggaaaagacgtgacgatccagcagctccgcgaggagggctttaaggcattctacgtggcaatcggtgcacagggcggacgcaaggccggagttccgggcgaggacgctgatggcgtgaagaccggtgtggaattcttaagaagcgtgaacctggatgagagcacaaagctttccggaagaaccgtcgttgtcggcggcggtaacgtggcagtcgatgtggcaagagcagcgctgcgcgcaggttccggtgaggtttccatgttctgtctggagtcccgcgacatcatgccggcggcaaaggatgaagtggcagaggctgaggaagagggcatttccgtaaacaattcctggggtccgaaggagattctgacagagaacggaaaagtgaaggcaatcgtcttcaagaagtgtctctccgtcaaggatgcggacggacgtttcaacccgcagtatgatgagaatgatctgatgaccgttgagtgcgagaacgtgctgctttccatcggacagtccatcgtctggggagatctgttaaagggaacaaaagtggagatcagaccgaacggcggagctatcgctgacccggtaacctatcagaccgcagagccggatatctttgtcggcggtgatgtatacacaggaccgcgttttgccatcgatgccattgcagcaggaaaagaaggatttgtatccatgcatcgttttgtcaatccgggacagagcttaacactcggacgtaaccgcagagagttcatcgagctggataagaacaacatcgacgtggagacatttgacaacgcaaaacgccagattccgggcacaaaagccggcgtggcaaaggagacattccgcgacttgcgctgcacactcaccgaggagcagatcaagacagaggcaaagcgctgcctcggctgcggagcttcggttgtggatgagaataagtgtatcggctgtggaatctgtacgacgaagtgtgagtttgatgcgatccatctgacacgtgatctgccggatgcaagccgtatgtggaagtctgaggacaaactgaaagcaattgcaccgtatgcgttaaagcgtcagtttgcgatcaagcgcaacaagaattaagaggagtcatatgcacgaactgggaattattgttcatatcgcaaagacgctggatcaggttgcagcggagaacgaattaaaaaaaataggatctgtcacgttggacatcggtgaggtcagcggtattgtgccggaatatctgacggagtgctgggaattttaccgcaaaaagaatccgctgatcgcagagtgcgagatgaaaattgagtcccttccggcggtcacaatctgtgaggactgtcagaagacctatgagacggttacttacggaagacagtgcccgcattgtggaagctatgaaacgtatcttgtgaccggcaacgaatgcagtatcaaggagatcgaagcctgctaaccggaggcggagagccctataacaatcttaaaatggacatggagggaaagacacggactgtttttccacccatgtccgttttgcgtctgtggaaaagtgacagctaaatggctgcgtgtctgcataaaataagaagaaggagtatggcaggggaggagtttctcgtgccggaaagaaggagaatttgaaaaatctgtatcagggagaccggggaatcctggtatcttacatgcagctggcgttaaagcgcgcggggtatccgcttttggtggacggcatctttggaacgaacacctgccgggcgctcgctgattttttgcagaccgaccgcacgccggaccgcatatgcgtggtggatcgatctgtctgggaaaagctgctgccgtatctgagaggatacgccacggaggagggagagaaccggatcctttttgaagacccggtaacgtcggtggaggtgccttatacgtcgctgctcacagcggcagtgattgacgggcttttggcgcgctacccgtttttaaagagcggggagatcggcaaaagtgtgatgggaaagtcgatttcgtatctggagatcggaaacggggagaaagaggtattctacaacgcatcttttcatgcaaatgagagcatcacaacgccggttctgctcaaatttgcggaggaatatgcgcaggcgtacgaaaaaggaacggcgctctacggcgtgccggcggcggaactgtttgaggagtaccggcttttccttgtgccgctcgtcaatcccgacggggtggatctggtgaacgggctgcttacggacggcgggtattaccggcgggcgcagcagattgcatcggattatccggcaattccgtttccggccggatggaaggcgaatatcgagggcatagatttaaatctacagtttccggcaggctgggaaaacgcaaagagaattaaatatgcgcaggggtacacgaagccggcgcccagagattatgtgggagaggtacccctgacggcgcccgagagcgaggcggtgtacgcgtttaccagatcacatgatttcaggctgatccttgcgtatcacacgcagggggaggtcatctactggaagtatctggactatgaaccggcgcgctcctacgagattgcgcagtattttgggcgtgtcagcggctataccgtggagcagacgcccacgcagtcgggatatgccgggtataaggactggtttatccaggaatacgacagaccgggctacacgatcgagaccgggatgggagaaaatccgcttcccatgtcggatttcgcgggtatctaccgggacaacaccggaattctgctgggcggaatgacgcagatttgacagagaaaaacgcctttcgtataatggagcgtagagtttacattaggagcagaagatgaactataagttatactgggagctgacaaatgagggagacgcgcggctgcttcgggcgtttggcgagacgccggagccgcgtttcccggcagagatagagggaagagcgattacggagatcggggactactgctttgcggcgcaggcgcatctcccggcagaatgccggtgcagttatgtgcaggcggagccgggagcagacggcgcaccggagacagcgccggacggggagatgcaggcggagccgggagcagacggcgcaccggagacagcgccggacggggagatgcaggcggagccggagacagacggcgcaccggagacagacgatgcgcttgcggaactggcgggggcatacataacgcgcgtgacgctgccggagggcataaaaaagatcggaaactttgctttttataatgccacggagctggcggaactggagcttggaagcgggatagacacgctggggagcgatgcatttatgaactgccggagcctgtcgcggctgttactgcatgcggaccccgggcaaaagacggggctcaggcttttgctggcacagctttcgtcggatctggaagtgaccttaagcggcgaaaacggcgtgtgggcgaagctgctgtttccggaatattatgagagctatgacgagatcgcgccggcacatattttcggcagaaatattgtgggggagggattccgggcgagacagagcttccgcgaggacgtgctcgatttcgcacagtacgataagattttcccgcaggcgtgtgtggatgaatcggaggcaacgctgggacggctggcactcgaccgcgtgcgctatgcggcggaactttcggaggcgccgcgcggactttacgaggagtatctgaaggcgcacagcggttatctcatccgccgcatcacggatgaccgggatctggaactggcggaggattgctgcagccggaagtttctgacgcgggaggacgtggcggcgtgtgccatgcgcgcgggggaagcggactgggcggagggagcggcggcgctgcttcatctgatgcagcagtatttcgcggagaaaacgccggacgagtgctattcgtttgacgatttttaagattgtttttacacggaaaagtacgtgcggatgcagggtattttgaaaaagaaaccggaagaggagagatggcatgggacatatacagacacaggaagaatgggaagtgcagatggcggaaaagatactttcttatgtgcgcaacgaactgtacctggaattgcggtatctggacgtcgcattctcggcgcttgtgccgcaggcggatgcgtcgttgcagagctttgccacggacgggggacatctgttctactccacagagcagatactgcgtgtgtttgagaaaaatgcaccgtacctaaaccgtgcctatcttcacacagtgctgcactgtattttctcccatccgtggattgcggggaaccgcgacaggcggctgtggaatctcgcctgtgatgttgctgtggaatatacgattgacggtctgggaaaaaaatgtacgaaacggatcttaagctggacgcgccagaagctgtacgaagaactgcgggaacaaaaaaaaggcgtgtcggctgccgtcgtctacgatcttttgtgggagcgctatttcccgctgccggcggagggaatgccggtctgtgaggaatggcaggcgttagcgcgcgaattttacacggacagtcacaaatattggccgaagagggagaacgatgcggcaaagtgtgcggctgcggcggacaatcagaaaaagtggaatcagatcgccaggcagacccgcatggagcaggagcggcggggagagaagcccaaggacggtgaagaccttttggcggcgcagcttgcggcggggaaaagcagacgaagctaccgggatttcctgcagaaatttgccgtgctgcacgaggaactgcatgccgacccggaggaatttgatctgagttattacacatacggactttcggtatacgggaatctgccgcttatcgagccgcttgagagcagggaggtagagaagatccgcgagtttgtgatcgtgattgacaccagctattccaccagcggtgaactggtcgaacagtttttgcgcgagacggcaaacatcctgcaccagagcgacagtttctttgcgcgttccgtgatccgggttttacagtgcgacaatgcggtgcgaagcgatgcaaagatcacgggtgagcaggagatggaggtgtttcttaagaactttacactccttggcgggggcggcacggattttcgcccggcattttcctatgtcaatgatcttctggaacagggagaattaaaagagctggcgggactgctctattttacggacggaaaggggcggtatccggcaaaacgcccggactaccggactgcgtttctgtttctggaggactatgacgaagcggcggtgccgccgtgggccatgcggcttttgctcgagaaagaggaatttttaaattgaggttgtatttttctgcgaaaggactataatagcagatatggaagcatagctcagccgggatgagcgttcgcctcacacgcgagaggtcacgggttcgagccccgttgcttccactggagagtaccgagagatcggtgctcttttttgcgtaatgggaaacaccgttcctggtattttttcttaagattcctttaaaacgatatgaatttatcgaaaaacgataaaaatatattgcaaaatggaaaaacatggatataataaagctgtgagaaaaatacagcagtaagattgcggaaaagaggtaattatgagtcagaaacaggtggcaggttggttaaaggggatcacactttcgattgcagggatgggactgttgttcttcgggctggtggtgccgtatctggcatgggacatggcggtgacatatccggactacgcggcgctccgcattccggggattctctacgggtggggcattgcggtgttctgctatgccattctctatcagttctggaaggtctgcgtgcagatcggacgcgacaattctttttctggtgagaatgcaaggtcgtttgtggtaatcagcaggctggcgtttgtgctggcggtggtctggtttgcaggaattctgttcctcgcggcaaagcgggcgcttggaccggcatttctgatttttatgattctgctcatttttatcaatgtggtgatcgcggtgcttgcggcggcgctgtcccatctgatctataagtcgtatgagatgaagcaggatgcggagttgacaatataggacggcagcggatcgtccggaaatgaggaagagaatggcaatcaggatcaatatagatgtcatgctggcgaagcggaaaatgagcgtgactgagttatcggaaaaagtcggcattacaatggcgaatatttcgattttaaagaacggaaaggcaaaggcgatccggatggatacgcttgataagatctgccggtcattgggctgtcagccgggagatattctggagtatgtagaggaagaaggggaggagaacggcgatggaagagatcatgatcggtagggaaatgaattcgaaggaaatgattccggaggaagaaaatcaggaaggggcaaagattttcgggaagctggcgggcgccagcctgctctatgcgcttgtatacacgggatgcctgtttgaaaatgtgatgggactggcgtcggtgctttgggtggcgtcgagtgtgtggtatgtacgttttgtgttccgaatgttcggggaaaaggagagacgggacaatggcattgtgctggggatgattgtactgcttggaatctctaccgttctgacgggaaacgaatggatcggctggatgaatgatcttattattttcgtgctgcttgtggggattcttctgcacaacttcgcgcaggataccgggtggaatttcggaaaatatctggcggagattgtggcggcggtgtgcggggcggtctgctttatcgggaagccgtttgcggatggcggagcattttaccgcagcaaaaagacaagggagagccatgcgggctggtatgttctcatcgggatctgcgcggcggtgccctgtctgatggttctggtgctcctgttaatgtctgcggacatggtatttgcagatttgctcgtacggtttgcgggagtgttccggttcccggtgaagctgcttcggattctgctcatgctggtgtttggattcttatcctcctactgcggtgtgcggtatgtacaaaagcacgcggcagacattaagccttccgccggaaaaacagcggaaccgctgatagcgattgcgtttaccgcgccgattgccgtgctgtatcttctgttttcggcaatccagatcgtgtatctttttatcggaaacatgcagcttccggcgggggttacttatgcggagtacgccagacgcggtttttttcagcttctgttcgtatgtgtgctgaatctggcggcggtgcttttcatccagagctattttaaggagaacagagtattgaaggcgctgctccttgccatttcaggctgcacgcttattatgacagcgtcgagcgcctgccggatgcttctctatatccgggcgtaccaactgacgtttctgcgtgtgtcagtgctggtggcactggcggtgattgcacttttgatggctggcgtgatcgcaaagatcgtaaaaccgcagtttccgctgttccggtatggatttgttctggtgggagcggtgtatctcgtattttccttttcgcatgtggattattttatcgccgcttacaatctgacgcacacctcgtgggaagcgtccggggaggagacggtggactacagctatctttacacgctctcgacggatgcggcgccggcaattgaaaaatatgcgggaaaaagcggcgcggcggactacagaaagcagggctggtatcagctgtactgcgaggcgaatgaagaggcattaaatgcgacgggacttcggacatataatgtttcacatgcggttgcaaaacagcttctgatggaagataatagagaatagagaaaaagccgggtgacagcgggcaccggcagaagcggaggagactggaatggaagaacagatggcgagacgccttgtcgcagcggagggaaaaaagctgcagcaggcgggactggtggcgagaacctggggcaatatcagctgccgtatcgacgagaatcattttgtcatcacgccgagcgggctggattatgagacgatgacggcgcgggatctggtgctgatggacataagaaacggtgtgtgctgcggcgcgcataagccttcgagtgaaaagggtgtgcatctggcggcgtatcagatattcccggaggtggggtatgtcattcacacccatcagacctatgccacggcgatcgggctctgcggctttgagcagcttgccatgacggaggaagaggcagagaagctcggcgggatcgcgagagcggcatacgggctttccagtacggagaagcttgcaggggcggtctacgatgccatgcagtcaggagcaaaggtggtctttatggtgcaccacggcgtgctgatctgcggaaaggacagggaggaggcgttttcccgcgccatgctcttagaggagatctgtaagaggagcattttgggacagccgaaaaagaagccgagaaaagaccagaagcgccaggaaaagctgtttcacgtcttacagaagcattttcattatgtgggaatctgcgatacgccggcagtccttctctgcgcggcgagcggacggggaatcccggcgcaggtggatgatatggcgcagatgatcggcaggaagattccgtgctgtcttcatgtgcgcagagatatgcttggactcttaagaaaatacggcgcggtgcttgtgccgcgtgtcggcgttgtggtatccgcgggaacggcggatgatgtggaggcgttaaaggcgcttgtggcaaaggcggcggtctgctgtctgcatgtgcgcgcgacgggcgcgtcggcaacgctctctccggtcaatgtggcgatccagcattatcattatgtgaaaaagtatgccctgcagaaagatggggaagcataagggcaggaggaataagatgaatggaaaacatgccatataccgcgtctatcaggcgctctgcgcggggatgctttccctgtttcctgcgggaagacagacgctggtgcagggggacgggtgtatcaccaggataccggaattattgaagacacacgggataaaaggggtgcaggtcattaccacgccgggaacgatccggcgcgggacggtcgcgccgcttctggcgcagtgtgaggatgccggcatccggacggtgttatacacaggtgtatcgcccgatccgaccgtggcggaggtggaggcggcagcggaatgttttttggtatccggctgtgaggcgatccttgccatcggaggcggctctgtcatagactgcgccaaggtcgcgggagcgcgcgctgtaaagagagatctcccggtcggaaaaatgagcgggatgcttaagatccacaaaaagctgccgctccttcttgcggtgccgacgacggcgggaaccggttcggaggtgacgctggcggctgtcatcacggacgagacatgccactataagcatgccgtcatggattactgtctcataccgcgctacgcatttctcgatccggggcttagctgttccctgccgccggatatgaccgcctatagtgggatggatgcgatgacgcacgcggtggaggcgtactgcaaccggttctgttccccgaaaatgaaagcgcatgccatgaaggcggtgagcctgattggtgccaatctgctgacggcttaccgcgaacctgcgaacaaggcggcacggatgaatatgctgaccggttcctacgaggcggggatcgcgtttaccaatgcctatgtcgggtacgtgcatgcgattgcacatgggatcggcggactctaccatgtcccgcacggggaggcgaatgcgattctgctgccgaaggtgcttgcggcatacgggagtgccgtgtatgagccgctggccaggctggagaggaaagtgcgcgcagcctgggggaagccggagagggaagtgcgcatgtccggagcagagccggagagggaagtgcgaatgtccggagcaggaatggagaggaaagtgtgcgcatccggggcggaggatggaaacagcaaggagacggacgccgtgctggcggaggcgtttattgagagaatccgccggatgaaccggagcatgggcatcccggagcagcttgccatgctgcgcaaggaggacgtgccggaacttgcggcgcgcgcgctcaaagagggcaatccgaactaccccgttcccgtgatctgggaagaggagcagatgcgggcgttcctgatggaacaggtaccaaagtaacagtacagtggacttcccagaaaaatattgcacaaaacagcagtcggattttttacaatttgacggtatacatcatgtacgcaaagaaatacatgcgtttctcttgcaattccatacagataatatataatgtctaagatggttaaaaaattaacgaatagaaaagggcgaggtaaaacacgatgtatgctgatgaaaacgtgatcaaaatcaaacacgacgtactctatgaagtggcaaagctggcatttgccggtgagcttgacgagaagagagacaatatcgcaatgagcctgatcccaggtccgacaccgcagtttcgctgctgtatttataaagaaagagagattatcagacagagagtccgtctggcggagggcaaagcgccaggtctgactgatgacggcaatgtgatccaggtcatcagttctgcatgtgaggactgtccgatttccagttatattgtaacggagaactgccagaactgtcttggaaaggcttgtatcaatgcctgcaaattcggtgcgattgagccgggaagaacccgctcccacatcgatcctacaaaatgtaaagaatgtggaagatgtgcgcaggcctgtccgtacaatgcaatcgcacatctgaagagaccgtgtaagttcagctgtccggtcaacgcgattacatacgatgagcacggtatctccgtcatcgataagaagaaatgtatccgctgcggtaaatgtatccacagctgtccgttcggagcgatcggctccaagagctttattgtagatgtaatcaacgcactgcgcgagggtaagcatgtctatgcgatggctgcaccggcgaccgagggacagttcggggatgacatcacgatggcaagctggaagaatgcgatgaaagaactcggatttaccgatttcttcgacgtaggtctcggcggtgatatgacggcagcttacgagtccgaggagtgggcggaagcttacaaggcgggcgagaagaaagttacctcctgctgtccggcattcgtaaatatggtacgcctgcactatccggatctggcagactgtgtatcgacgacggtatctccgatgtgtgcggtttcccgccttatcaaggcaagagatccggaagccatcacggtatttatcggaccgtgtatcgcaaagaagtctgaggttgtggatcagcagattccgggcaatgcagactatgtactgacctacagtgagatccgtgcgatcatgaaagcgaagagcgtcgtactgcagccggctgcaaacgatgatcagatcgcatccaccttcggtaagcgttttgcaaattccggcggtgtaaccgcagctgttcttcagagtctgaaagagtctgaggatgagatcgatgcaaaggtatgcgttgcaaacggagctgccgagtgtaagaaagcactgcttcttctgaaagcagccagactgccggaggatttcatcgagggtatggcatgcgagggcggctgtgtcggcggaccgagtgcgttcaacgaccagatctcttccaagaagaaccgtgacactctgatttcccaggcagatgaccgtggaattcatgagaacattgagcattacgagatgaacaccatctccatgcacagagagtaacaggatatttgaaatagaaaccgcaagttgccagacaccgcgcgggctgatataatgagttcagcccgcgcggtgttttttttcctttataggataggatgtgcaccatgcggcggggaagagaatgttttgcatatagcagaactgacttttacgcaagagaatgggaattggagagaaaagatgaaaaaagcagtgttttttgatatagacggaaccttgtggaatgagcacatgcaggtgccggaaagtacaacggaagcgatacgcgaacttagggctgacgggaattacgcgtttttgtgcagcggcagaagccggtcgaacatccgcagtgagaagatccttggaatagggtttgacgggattgtggcggcgtgcggcacacatattgaatatgaaggaaagaaggtgtgcgagaggctgcttacgcctgaagaagcggaggaacttctacgtgtcattgaggcataccacatggaagcggtgctggagggaccgcattatatctacgcaaacggggaagattttaaggaagatccgtttatccagtaccttcgcagggaactgggagaggatgtgcgggagatccgcgggcagacggagtatgagatcaacaaattgagcgcttatatgaacggggcgagcgtgcgtgcggtggaagcggagctggtgccgcattttgatgtgattgaacacaatccgcagctgattgaagtggtgccgaagggctacaccaaggcgaccggaatagcgcaggtatgtgacatacttggggttgccagggagaatacgtatgcgttcggcgacagcacgaatgatctggagatgctcacctatgtgggacatggcatcgccatgggaaacggggcatctgcggcgaaggctgccgcggagtatgtgacgaccgatattatgaatcatggaattaaaaacggactgaagcactatgggctgatcggataggaagcaacgggattgcagcgggaagagaaggaggagcgggatggcaaacatgatggattatctggactggcggggggatctgactttcaccgcgtccggatttaacgaggtggataatctgctttttgcggagctggtatatacttcgtttgacgggattgtgaccgggcagagcgaggcggaggcagtcacgcttgcggaggcatccgccgcgttctgggagcagaacagcagggaggagatccttgcgcgggtgtcaatgacaaaggcggcgccgtttgttttggagaagatggcgaaaacagagcgttttcgtgacgtgaagctctggggttacgtcaatgacatcagtgaggaggagcagtcacagtttgcggtcatgtgcgccgggctgccggatggcagtatctatgtgtcgttccgcggcacggacaatacgatcacagggtggagagaggattttaatatgggatacctctcggagacgcccggtcagctgaaagccgctgcgtacgtggaacagatgcttggagatggcagctgccccgtgcgcatcgggggtcactccaagggcggaaatcttgctgtctatgctgcagtccactgcagcagcgggctgcaggaccggattcttgcggtctacagcaacgacggacctgggttccgcagggatattgtagagggcgcggcataccagcgcgtactgccgaaaatccacacgattctgccggaatcttcgattgtcggaatgctcttggagcaccaggaggcgtatgaggtggtgcgcagttccaacagtggaatccagcagcacgatgccatgtcgtgggaggtgctcggcacatcctttgtctatgtcagggaggtggcggcccagagcctgatgttggatgagacgatgaaggcatggatttaccagctgaacggggaggaacgcgaacagattgtggatacggtattcggcatgcttgaagcggcggacattaagacggtggatgatttttaccacagcaaatggaaggcggtgcaggagctgatgaaggcgaaaagccacctgccggagaagagccagaaggtctttgcaaaagccttaaaactcctgtggtcggagggaaataaaactgtccgcaaaacggtgaaacaggtcgttggagagaagcgacggtaagtttctaaaaaaagtataaaatcacaaaaaatggatgaaaatataaaaatacaagaaaacaaaagaaaaaacgagaaaagagcaatataaatgcaaatataccggaatatatccggttgcagatcacatgctaaaaaactattataacactatcggttagcactcaaacgaaatgagtgctaataacaaaacgaaagatattatttcagatcataaaacaggaggtctacaaaatgaaattagtaccattgagtgacagagttgtattaaaacagtgtgaggcagaggagaccacaaagtctggtattattcttaccagcagcgcacaggagaagccgcaggaggcagaggtaatcgccgtaggtcctggcggaatggtagacggcaaggaagttaccatgcaggtaaagaccggacagaaggtcatctattccaaatatgcaggaacagaagtaaagctggatggagaggaatacatcattgtaagacagagcgatattctggctgtcgtagaataagcagctgggaagcatccctgtaatttgaatcagaataagagatagagaggtagatcagtcatggcaaaggaaatcaaatacggaacagaggcaagaacagcattaggagccggcgtagataagctggcaaataccgtcagagtaacactcggaccgaaaggaagaaacgtcgtactcgacaagtcctacggagcaccacttatcaccaacgatggtgtgacgatcgcaaaggagatcgagcttgaggatgcattcgagaacatgggagcacagctcgtcaaggaagttgcaaccaagaccaacgatgttgccggtgacggtaccacaaccgcaaccgtacttgcacaggcaatgatccaggaaggtatgaagaatctggaggcaggcgccaacccgatcgtgcttcgccgcggtatgaagaaggcaacagacaaggcagtggagtccatccttgcaatgtcttccaaagtaaaaggaaaagatcagatcgcaaaagttgcagctatctctgcaggtgacgaggaagtcggcaacatggtagcagatgcgatggagaaggtatctaacgatggcgttatcaccatcgaggagtccaagaccatgcagacagagcttgatctggtagaaggtatgcagtttgaccgtggatatgtatccgcatatatgtgcaccgatatggataaaatggaagcggttctggatgatccgtatatcttaatcacagataagaagatcagcaacattcaggagatcctgccgttattagagcagatcgtacagagcggcgcaagacttctcatcatcgctgaggacatcgagggcgaggcacttacaacattgatcgtcaacaaactgcgtggtactttcaatgtagtggcagtcaaggctccgggctacggcgatagaagaaaggcaatgctcgaggatatcgcaatcttaaccggcggtcaggttatcagctccgatctcggattagagcttaaggataccacaatggatcagctcggacgtgcaaaatccgttaaagttcagaaggagaacacggtaatcgtggacggtgcaggcaataaggacgctattcaggcgagaatccaccagatccgcggtcagatcgaggagacaacttccgagttcgacaaggagaagttacaggagcgtcttgcaaagcttgcaggcggcgtagcagtgatccgtgtcggcgcagcaactgagacggagatgaaggaagcaaagcttcgtatggaagatgcgttaaacgcaacgagagcagcagtcgaggaaggcatcattgcaggaggcggttccgcatacattcatgcaaccaaggatgtggcagcactcgcagatacgcttgagggcgatgagaagaccggtgcgaaggttatcttaaaggcattggaggctccgctgtactacatttccgcaaatgcaggattagagggcgcagtcatcatcaataaagtaaaagaatctccggcaggcgttggatttaacgcagcaacggagcagtatgtagacatggtagagcagggtatcctggatccggttaaggtgacaagaaccgcattacagaacgcaacttctgtagcatctaccttacttaccacagagtctgtggtggcaaacatcaaagaggacgcaccggcaatgccggcaggcggcgcaggcggaatgggaatgatgtaaatcccatccgaagagggaatccatcccggtcaatcgaccggggtggattttttttctgcaattagaaaactgtgttcttattacagaaaatgtttaaaataaaaatatttgaaaaatattgcgataattgcaaaaagggaatataattcaagaaaagtgaagcggcacggaggaaatgcgtatgaagatccttgcgacatttgatgcccgtgattatgagggcacgacgggtatctatgaaaagtattcgatacgggcgatcattgtgcgtgacggcaggcttgccatgcagtgcagccaggagggagaatataagatccccggaggcgggcaggagccgggtgagaattatgagcagacgctgatccgtgaagtaaaagaggagacaggactttatgtcaggccggagagtatctgtgagctgggcgagataatagaactgcacagagatatttttgagccggataaaaagtttatctgccattctctttttttttactgcgatgttttggacgagcaggcgccactttcacttaccccgagtgagattgcaaaggggtatcagttaaaatgggcgacgccggaggaagtctatcacaggaatattctgattgagaaagattcctggattatccgggatacggcgtttgtgaagatgctgatggatggaaagatctgtctgcccgggtgagatcttacaaaggaagggattgttatgaaattaaaacaaaaacaaagattggaacgcaacaagattacattcatccttggacttatcatccttgggcttttgaatgcactgacactgcttggatttgtggatgcaacagcggataaatctgttgtgctggcacgcatggtagtcaatgtcattcttctcgtgatattttttgttggacatgtccggtatcgcggggataggaaatttgttatgatttcactttcgtgtatgtttcttacctatgcagtgatgatcttatcaaacaaaaacgtggtcttttatgcatttatgtatttaattatgcttacggttatgttgtatcgtgatataaggctggcacgcatcagcgctattgcgatgggagcgctgaatgtaatttcgggcatacttcattttgtgaaatatcctgggacacggagcgagtcagttgtacagatagtgtttgccatttctttcggtgttgtgatgtgtattgcggtagatctgcaggcgagacaccatgttgaggatacagatgccattaagtcacagatggatgcggcggcgcgtgtggcggatgagatcattcagatgtcgggagcgctgtccgagaagttcgacagtgcgagagagaaagcggatgtgctgacggagagcatggtcagcagcaacaactccgtcaaggagattgcatcgagcgtcaagctgacggcggaagcgattgagcagcagacgatgcagacgaacggcatccagacgaatattgaaaacgccgaaaaagagacgaaagagatgcagacggcgtcagatgcgacacaggacgcgctccgtgagggcgctgacctgatcgccgagctgaaggagcaggcaacccagacggcggagatcaaccgcgccacaagaaccacgacggaagaactggacaaccgcataaaggaagtggaggtcattatcggaacgattttaagcatttccgatcagaccaatctgcttgcactcaatgcgtccattgaggcagccagagcaggggaggctggaaaaggctttgcggttgtggcagacgagatccgcaagctttcagaggagacgaaggagtcgacgggaaagatcacggagattatcgaaaaattgacggtaaatgtggaggaagcctctgtaaatatgcagaagtcagcggagtctgcagataagcagaacgagatgatcgagacaacgagagagaagtttactgttatcgaggataagatgaatttgttccagaattctatgcagaatttgtctggtgaggtggagagtatcctttcagcaaatacgcagatcaatgacagtattaccaatttatctgcaacgagtgaagaggttgcggcatcctcagaaaacagcatgtctatgagtgaggatagtatgcagaatatggagaatctgaatgatctgcttggcgaaatttacaagatttcggagagaatgcgtgaggttgtagcacaggaacaggcgtgatgcggtatacaaaagtatacatgtagaatgaatagaagagtcattttagcgtttttaataatagaaagcgtgctacggtgcgctttctattattttttggtggcggtccgggacaaaatatggtacaatgcattagaaaaatgataaggggggatccagagattatgagtgaagattttattacaatgacaataggaaaacaaaagaatattgcactgattgcgcatgacaataaaaaagcagatctgattgactggtgtgagcagaacaaggagattttaaagcagcattttctatgtggcacaggtacgacagcacgtatgattacggatcagacaggactcccggtaagaggctataacagtggccctctcggcggagaccagcagattggcgcaaagattgtggagggaagagtggattttgtgattttcttctctgacccgctgacagcacagccgcatgacccggatgtgaaagcgcttttgcgtatcgcgcaggtgtatgacatcccgatcgccaacaaccgggcgtcggcagattttatgattcattccacttatatgaatactgagtatgagcatgagatcatcaattttaagaagaacatcaaggaacgatcagagacattgtaagggagagtagaagttatgagcaaagtagcaatcgtatctgacagcaacagcggaattacgcaattgcaggcggaagaacttggaatcaccattctgccgatgcctttttttgtgggagacaagacattatatgaggacattgatctgtcacagaaagagttttatcagatgctgtccgagaatgccaatatttccacatcgatgccgcttgtcgggaatgtgacagatacatgggatgcattgctgaaggagtatgatgagattgtgcatattccgatgtcatccggcctcagcggctcctgtgagacggcgttgatgctggcgcaggattacgagggaaaggtgcaggttgtgaataaccagagaatctctgtgacgcagcggcagtctgtgctggatgcgatggcgttggcagagcagggacgcagtgcagtggagattaaggagattctggagagagataaatttgagtcttccatttatattatggtggataccctgtattatctgaagaagggcggacgtatcacgccggcggcggcagcgcttggaacgttgttaaagttaaagccggtactgcagatccagggagagaagctggatgcatttgccaaggcgagaactgtcaagcaggcgaagaacctgatgatcgaggcgatgaagcacgattttgcggagcggttccatgatccggaaggaaagagtatgcatctggagatggcgtacacgtacgatctggatgctgcggaagcgttcaggcaggaggtgcaggaagcatttccgggactggagattcatatggatccgctgtcactgagcgtatcatgtcatattggaccgggggcacttgctgttgcctgctcgaaggagattccggagctggaagcgtagataaaataaaacaggacaatataaaagaccgtattccgggatgacggagtacggtctttttgatgcaataggatgcatttccgtgtgagggaaaaatgtttacgccgccttggaacactgcttcatccggtgctcccagagaagataggtgataaacagcgggatgccggcaccggcccaggcagccggatcagcgaagcagacaccgaagaagccggtgctcgccggaacgagagcgatgacgccgaagcggcaggcgagctcgacgacaccggagagcatggggatcagtccttgatccaggccctgtaaggcattgcggtataaaaagatcatggcgagcgggagaaagaaccagcttgcgatcgtcaggtactgcatggcggaagagaagatctcctcggaaggattgctcacgaaccagctcacaataaaacgtccgccaaagatgcagatcgcggcggctgtggctgccgcaccgaagcagaggagaagtccctgccgcatgccggcgtagatgcggtcgtatttgccggcaccgaggttctgtccgcagtaggttgccattgcggtgccgagtgtcggcatggactgggtcgcgatattgctgaccttggaggccgcggtgaaggcggcgaccacactcgagccaaacacgttgaccgcactctgcataatcatggtgccaatggcggtaattgagtagttgagcgccatcggcacaccgatggcgagcatgttttttacgccggcggaatccagataataatcctcatgtctggtgcgcaggatatcgtatttccggtacatataaaagaagcagagcacggcggagactccctgtgcgatgattgtcgcgtaggcggctcctgcggttccaagccctgtgtacacgatcagtacgacatctaagatgatgttgagcacggacgagagaatcaggaagtagagaggagtgcggctgtcgccgatgccgcgcaggatgccggataacacgttgtacgccattgtcagcagaatgcccgcaaaaattaccttaatataagcgtctgccatggcaataatattttccggtgtgtgcatccatgccagaaggaggcgggaagctgtcaccgttgggatggtcagcagaagcgatataatcagtgtaagaatcagggagagcgccacgtagtgacggagcagcttaaaatctttggctccgaaagcgtgtgaaaccatgacgccgaagccctgggcgatgccgttggcaaaaccgagcacaagaaacatcaggcagccggttgagccgacggcggcgagagcctcctcgccgagatagcgtccgacaataatcgtatctaccatattatagaactgctggaacagattgccgagcagaaccggaatagaaaatagcaggataatccgaagcgggctgccggtggtcatatctttggtcattggattgcgtctcccttcatagtctgttatagtagagatactggtactttgcgtaaggcatagtatacttcatgacagtggaaaatacaatccgtttttgtaaaaaaaatgagacttttttcccaggagagatccatggacatcaatctggaatattataaaattttttattatgtggcaggctcccagagcatcacattagcggcggagcagcttaccatctcgcagcctgcagtcagccaggcggtgaagcatttagagcaggcgctttcgtgcccactgtttgtgcggacgaccaagggcgtgcggctgaccaaggagggagagatgctctattcctatgtgcagcgcggctatgaaacgatcctctcgggcgagaggaagctctctgagatgctgaatctggaacagggcgaaatctgtatcggtgccagcgacatgacgttaaagtatttcctgcttccgtatctggaagaatttcatgagcgctacccgggaatccgtgtgacggtgacgaatgcgccgactccggagacgatccgccatctctgcgacggccgcattgattttggcatcgtgagcacaccggtcgagaagagagcttcgctcaaatgtattccggtgaaggagatccgggatgtgtttgtggcaggcaggaagtttgaatatttaaaggagcgcatgctggggtacgaggaactgatgaagctgccggtcatgtgtctggagggaaatacctcgaccaggacgtatgtagagcaattccttgcgtcgaagcaggtgacgatccggccggagtttgaacttgccaccagcgatatgctgatccagtttgcggtgcgcaaccttggaattgcaagtgtggtcagaaattttgccgaggagcacctgacggagggagatctgtttgaactgcggttcttggaggagataccggcgcgtacgttctgcattgttgcaaatgaacggattccgctgtccgccgcagcggctacgctgatgaatgttctggtacaggggacatcacagtaagcagggattttcttttagaaacaggcataataaatacttatgccacatataatgaatattgattttacttatacaaaaggttcgtgtataatcaataagtaaaaaggcggaagtgagtgacggttttttacaaccgtcactttttatgtcatgaggcagatttacagagtggatgctgctttcggacagaccggccgcatggatgcagcctggaatcaggaaaatgcggacttccggcaaaaaagtgtatcatatcaggaggaaaaacatatggttacagcagtagtaggcgctaactggggcgatgagggaaaaggcaagatcacagatatgctcgcggatgaggctgacatcgtcatccgttttcagggcggagcaaatgcaggacacaccattgtgaacaattatggcaagtttgcactgcacacattgccgtccggcgtattccacagccatatcacaaatattatcggaaacggtgtcgcactcgacatcccgaaggtaatcggcgagctcaagtcgatcacagaccgcaacgtaccggcaccgaagctgatgatctcggacagagcacagatggttatgccgtatcatgtcctgttcgaccagtacgaggaggagcgtctcggcaagaattctttcggttccacaaagtcaggaatcgcaccgttctattcggacaagtatgcaaagatcggtttccaggtcagcgagctgttcgatgaggagctcttaaaagaaaaggtaaagcgcacctgcgagacgaagaacatcatgctggagcatatgtatcataagccgttattaaaggaagaggaacttcttgcaaccttgcatgagtacagggatatggttgctccgtatgtcggggatgtctccttattcctcgatcaggcaatcaaagacggcaagcgtattctgctggagggacagcttggaactttaaaggatccggatcacggaatctatccgatggtaacatcctcctccacgctggcagcttacggtgcgatcggagcaggcatcccgccgtatgagatcaagaagatcgtaacggtgtgcaaggcttattcttccgcagtcggagcaggcgcatttgtcagcgagattttcggggatgaggcagacgagctcagaagacgcggcggcgacggcggagaattcggcgcaacgacaggtcgtccgagacgtatgggatggttcgactgtgtggcaagtaagtacggctgccgtatgcagggaacaaccgacgttgcatttaccgtgctcgatgtattgggatacttggatgagattccggtatgcgtaggctatgagatcgacggtgaagtgacaacagatttcccggtaacagcaaagcttgaaaaggcaaagccggtacttaagaagcttccgggctggaagtgcgatatccgcggcatcaagaaatacgaagatctgccggagaactgcagaaagtatgtagagtttgtggaggagcagatcggatatccaatcacgatggtatcaaacggaccgggcagagaggatattatctaccgcagcaagtaggatgacgcatatgattaagaatgtcatttttgatgtgggacaggttctggtggcatgggaaccggtggaggcgatgcgcgcgcttggaatggatgaagagacggtgcgcgcagtcgcagatgccacggtgcacaccagtgactgggacgaggcggaccggggagccctgtccgatgaggaacttctcacaggctttatcagaaaagctccggcatacgaagcacagatccgcaatttctgggagcatgtggaccgggcgatttatccgtttccgtatgtcggggaatggatgcggacgttaaaagacaaggggtatcgcctgtatatcctttccaattacggtgcctggacatacgcgaagacgaaggatcagtcgcttggcttccttaaggacgtggatggagcattgttttccttcgaggtgaagcagattaagccggagccggagatttatcactccctgcttgagcgctttcatctgcgcgcggaggagtgcgtgttcctcgacgacagacagaacaatgtggacggtgccatcgcctgcggcatctctgccattcgttttaccggctacgaggacgccagacagaaattaaaagaatacggtgtagagtgctagaaagggaactgtcgcaagaagcatatcgtgctttgggctgataagtaatatcattagaagatcacatcgtgggatttcagatgaaaatgcagatggacattcggttcaaaaaatgtggcatttctaaccagccgaatgtttgcatcttcgatgatccgtgtttttccaagtttggagcactccgcgggtcatgtccgcatcccggaagacaatttgtaggacttttgtgtgtgtcccttatggcacctctgaacaaaacataaccgcgcgaagccgctgtctgagtcggcatctgccctatttttaatagcagatgccggcgagttcggttcgcgcggttttatattgtctgtgaagaggtgccattagggacaccagaaagtccgcccattgtctccggtgtgtcggacatgcacccgtcggattgtccaaacgtggaagagacacggaatccgatgcaaacattcagcaggaagaaatgctcacatttttctcaaacgaatattccatctgcatttccacatgaaatccccaagtgtgtttcttataatattacttatcaccccaaagaggtctatgcttattgcaacaattcctttgggtttgttttcacagaattatcacagaatgattcccttttgaacacatttctttcgtaggctagatacggaaacaggaaaaaggaggaaatggttttgattgaaatcaatcatctggtcaaaaaatatggggaacatgtggcggtggatgatctgacgcttacggtggaacccgggaaaatctatggttttctcggaccgaatggtgccggaaaatccacgacaatgaatatgattacaggataccttggcgcgacgagcggcgaggtgaagatcaacggtcacgatatttttgtcgatccgcaggaggcaaaaaaatgcgtggggtatttgccggagataccgccgctctatacggagatgacggtgcgggagtatctggatttcgtggcagagctgaaaggtctggataaaaaggtaagaaaaacacagacagaagagattatggagctgacacacacgaaggaagtgagtgagaggctgatccgcaatctctccaaaggatatcggcagcgcgtcggctttgcacaggcaatcatggggtatccggatgtcattatactggatgaacccacggtgggactggacccgaagcagatcatcgaagtgcgtgaactgattaaggagctcgggaaaaagcacaccgtgattttgagttcccatattctgacagagatttcggcggtctgcgatcatgtgtttatcctgtcgaagggaaaacttgtggcgagcgattcgacggaacatctgctggagcggatgtcgggagcacaggaaatcgcgcttctggtaaaagacaaagagcagcgcatggaggaacttttaaaggaacttccgggtgtggcggaagtgagcagagagccgggagaagcagcggaggaagtcctgtttcatgtgacggcggagcggggcgaagatatccgtgaggcattgtttcatgcctgcgcaaaagaagagattccggttctggaaatgcacacggagacaaaatcgctggaggatgttttccttgaacttacaggagcagacgggaaaggagaacaggcatgattgcaattttaaaaagagagtggaaaagttattttcagaatatcacaggatggctgtttatcgctgccgttctggcactgtacggtctgtactttttagcgtataatctgcgggcgggatatccgtatgtgtcgtacacactttcggcgatctcgtttatcatgttgattgccgttccgattctcaccatgcgttccatggcggaagagcggcacagcagaactgaccagctggtactcacagcgccggtttcgcttggaaagatgatttttggaaaatttttagccatggtgggcgtttttaccgttgccgtggcggtgattgcggtaacgccacttgtcctggctgcctttggcacggtgccgatgggagaaaactatgtggcggttttgggcttctggctgtacggatgtacctgcatcgcagtcggtatgctggcgtcggcgctgacggagagtcaggtaattgcagcggtcgtggcgtttgcattcctttttctgggatatatgatgaacagcatcacgggattgatcggcgaccatctgatcacgaaggtactgggcgcatatgatctgtacacaccgcttcagagttttatgagcggctgtctggatctgacgggcgttgtgtattttgtcagtgtgacggcattgtgtctgtttttgacctgccagtgtgtgcagaagagacgctggagcatgacgacgaaaaaactgaccacaggaatgttttccgtggcgatgattgtggtgggatttgcggttgcggttgcagtcaacatggtggtaaaggagatgccatcctcctggacggcggtagatgcaacttccacaaagctgtacagtctgacggataccacaaaggattatgtgaaaaatctgtcgcaggacgtcacgatctatgtgctttcgtccgagaagtcggcggacagtacgttggcggagacattgcagcggtatgaagatctctccaaacatttaaatgtggtttacaaagatccggcgaagagtccgaatttttatcagcagtatacggacagtgcgccgagccagaacagtatgatcgtggtgtcggacgcgagatcgcgcgtggtggattacagcgacatctatgaatattcttatgactattctacatattcaagctctgtggacggttatgatgcggagggacagctgaccagcgccctgcagtatgtgacgaaggcagacagtgaacttccggtcatctacgagattaccggtcatggagaaaataccctttctggcggtttctcggaggcggttgagaaagccaatatgacggtgtcacagctgacattgctgacggaagatgcgattccagacgatgcagcggcaatcgtcatcaacggaccgacatcagacttttcggaggatgatgccacgaaggtaaaggagtatctgcaaggcggaggaagagcgctcatcgcctgcaacttcgagtatcaggatctgccgaattttgcttcggttctggaggcgtacggcattgaacgggtagctggcattgtgatggaaaacagtgcatcagcatgctaccggagtaccccgtattatctgttgccggaaattgagtcgacagcctatacttcatctgtgacgggcgagtacattttcgcgccgtacagcgagggactgagttatccggaggaagcggaagatattacctacacaccgctgcttgtcacaagcgatcaggcggtgtccaagacggatgtggcaaatgcggagacgtctgagctggaagacggggacattgcaggaccgtttacgattgcgctggcggcagagcaggatgtggatgacggcaacacgatgaaactggtggtgtttggctccacggaaatgctgaccgacaatgcggactcgattgtatcgggaagaaatgtgtccatgttctcagatgcgttaggacagcttgccggtgacgacggagagtcgacgggcgtcattccggtcaaggagtatacgcttggaacgattacggttacgtcactcggaacgctgatcggcggacttgcggcaacggttatcctgccgattctgctgattgtgaccggtgttgtgatctgggcggtaaggagaaagaaataatgaagaaacagaaaaaacagttctttggcatgctgcttgtcctcgcagtgcttgcagcagcctatggaggaattcatgtatacaatcagaaacaggaggaaaaagaggcgggcgaggagaaaacagagaaacttacagttgtcgattttgaaaccgatgatgtgacggcattctcgtacgtgctgggcggtcaggtgtatgcctacacgaaaacggacggagagtggacctgggacggggatatttcactcaccctcgacacgtcacagatcgacgccatgctggatgcggtcacgggccttacggcggagagtgagattacagacggcgaggatctggcgcagtatggtctggaaaatccgtcggggatcattaccctcaccacggcagacggcacgacgacgctacagctcggagataaaaatgcagtgaccgggcagtattacctgaaggtggcagagagcgataagatctatctcgtgtcgcgggatctctccggcactttctccaagacaccgcaggaattgttaaaggaggaagagacggatgagcctgagagtgtggacgtgactgagggcgtagaggcggctgtgggcgtagacgtgaccgagagcgccgcgtccgaggacagtacggaagagtagaggacggatcaaaagagccactgcacgggcagggagatggactccgtaataagagaaaaacgatagatgttccagatacaaaggatgcggacattctaaacacaaaatgcggaatttctaaccctgcccgccgaaacatccctgatgatccatgtcttttcaagcttggagcactctacagggtgtgtccgcaagccggcagacaattttaggactttcgtgtgtccctttggacaccgctgaacaaaacataaccgcgcgaagccgctgtctgagtcggcatctgccctgtgttcaatagcagatgccggcgagttcggttcgcacggttttatattgactgtgaagcggtgcccattagggacactagaaagtccgctcattgtctgcggttgccggacacaccctgtggattgtccaagcgtgacaaagacacggaattcgatgtcccggcgggcagggaagaaattctctcattttgtttcaaagaatccccgcatccgtttgtattctggaacattctgtcggtttttctcttatcctgaaatttgtatctattttccctgcccctgcggcggctccttttgctcggcgtcctcttcggacgacttgtgcacgagcttatagatgagcgtgtacgcccacagcagaaccggaatgatgacggtcgcgtagatggagaccatcagcagattcataaaattctcgctggaacttaaagcgcagacgagcgtggatgcatacagcaaaagcagaagaatggcgccggctgcggcaagaatacgtttcacttttttcatggtaacctcatttctaaacagccttctggtttacggctgtacctttatggtagatggaaaaggcggttccgtcaagcagaaaaaatttacacgaattgtacaaactttataaaaaccatataaagtttactgaaaacacaaaaaatattacaggaatttgatagctgcctcccggtggaactcttacaataaggactgttgagtttgcaatgtaagagagcactgggaggttttattttggctgaattggcgttagaacatgtgggaaaagtataccggaacggttatgaagcaattcatgacttttcgcttgagataaaagaaggagaatttttgattctggttggaccgtccggctgcgggaaatcgacgctgctgcgcatgatcgcaggtttggaggacatctcgtcgggcgagctgtgggtggacggagagatcgagaattacaaggagccgcgggagcggaatctcgccatggtatttcagaattatgcgctgtatcccaatatgagcgtgtacgacaatatcgcattttccctgagcgtgaggaaggtcgataagaaggagataaaaaagaaagtatacgatacggcaaagatgcttggcattgagcatctgctggacagaagaccgggagaactctccggcgggcagaaacagcgcgtggcgatcggaaatgcgattatccgcaatccaagggcgcttttgatggacgagccgctgtccaatctggatgcgaaactgcggacgcagatgcgggtggaactggcggcattgcagcatgcggtgggaacaacgacgatctatgttacgcacgatcagacggaggccatgacgcttggcacacggattgtggtgatgcgggatggaaaaatgcagcaggtggatacaccggcgaacctctatgcaaagccggtcaaccggtttgtcgcaggattcatcggaacgccgtccatgaactttttcgaggcacaggtggtttcctgggaggaggctccggcgcttctggtcggggagtaccgcatgatgccgtgcagggaggatgcagcgcggataagcagacacggaagcgacagcgtgatccttggcatacgcccggaaaacatcctgtgggaggcaccggaatgtgtaagcgccggggcggattacgtggagacgatgattcttgaggtggagctgctcggagccgagaagcttttgtttttccttttatacgggaaaaagtatgtggcaaagattccggcggaatatgacgcccgggcaggtgaggtgcgccggctgtacttcgatgtgacagcgatccatctgtttgactgcgacagtgaaatgcgcatctgaaaggagacaacatgaatgcatttgtaaagctaagacaaaagatcagcccgtacctgtttttggtgccgtgtcttatcgtattcggactgttcttatgtatgcgctttccattgcgtttatgccatccggggaattgttctcgatggagatgaatctgattccgaagcagccgacgcttgacaattttgcacaggcgtttacaaagattccgctgtttcgttttattttaaattcgtttctggtggcgggatgcattacgctcggacagattatttcctgctcccttgcggcgtttgcactgtcatttctggactttaagggaaaaaatgtgatttttatgctgatcatggcgacgatgatggtgccgggagaagcgacgattatttccaattatttaacggtaagcggatggggctggctgaattcctacaaagtgctcatcattccatatatcacttccgccatggggatctttttgttccgtcagttctatctgacctttccaaaatccctgtatgaggcggcaaagatcgacggctgtccgaatctggtgttcattgtccggattctgatccctctgacgaagtcggcgatcggagcgatggcggtctataccttcatcaacgcttacaacatgtatatgtggccgttgttagtaaccggaaccgaggagatgcgaaccgtgcagattggtatcagcatgttaaacagtgtggattcccagtcgattacgatggtaatcgcgggagttgtgatggtgattctgccgtcgctgtttgtgtttattctaggacaaaagcaactgatccgcggtatgttttccggtgccgtcaagggctgacatagaaaaaaggaactcactaattcaaaaggagaaaaaagaggaatgaagaagagaatcattgcatcattgttaacagcatccatgcttgcagcagcacttgcaggctgcgggggaagcacggcgcagacggcggatacgtccgcagacgctgcaggggaagcggagagtgcgcagggtgatccggcaacggtgacggaaaaagagacgaatgtgtccgccacggcagatgcggatctttccgggacgacgatcacattctggcattctatgagcggtgtaaatggcgaggcacttaccgcgcttgtggatcggttcaatgaggagaacacctatggcattacggtggatgcggagtttgagggcgagtacgatgatgcgatcaacaaattaaagagcagcatggtgggaggaagcggtccggatctgattcaggtctatgagatcggcacccgtttcatgatcgactccggctgggtgattccgatgcaggagctgatggatgcgaacggctatgacaactccaatatcgtgccgaatattgccgcttactacacgatcgacgaccagctctactccatgccgtttaatacatccacgccgattctctattacaataaggatatgtttgatgcggcgggaatcaccgaggtgccgacgagcctggaggggatcgatgcgattgccgacgatcttgtgaacaagggcggtgcaggagaggcactttccatgggaatctacggatggttctttgagcagtttatctgcaagcagggactggcctacgcaaacaatgacaacggaagaagcgcggcggcgacagccgtggattttgacggcaacggtgcggctctctcgatcgtatccgcctggaaggatctctacgacaagggatatgcaccgaatgtgggagttggcggcgatgcaggtctgacagacttctccgcaggaaaagcggcgattacgcttggctccaccgcttccttaaagcagatcttaaacgatgtcaacggctcctttgaggtgggaaccgcatattttccgggcatcaaggatacagatcagggcggtgtgtccatcggcggagcatccctctgggcaatccagaatcaggatgacgtaaaggcacaggcaacctggaagttcgtggaatatctggtatcggcagagtctcaggcatactgggcaacccagacaggatatttcccggttaccaacgatgcgtacaatgaggatgtattcaagcagaacatcgagcagtacccacagttccagaccgcgatcgaccagttgaacgacaccaagggcgagtacgcgggagcgcttctctctgtatttccggaagcacgccagacggtacagaccgagatcgagaacacgttaaatgacaaggagacaccggaggaggcagtgcagaagatggcggacacgatcaacgcgtccatcgaggactacaatctgctgaacgaatagttttttagtggcaggcaatagggtaagcgacacatcccaccgatttcagatggaaatgcagatgaaacattttttgatccgaatttccagatacattccctctgaaatcgaagggcatgatcttctcaccctattgcctgccacgtcaaaatgaacgatctgcttccgtcgacgtcctgttgcttttggcgggttctgtaaaaaagtctttgaaatatgccggaaaatttgttataatactatagtgcatctttgacatagcagatgtcggacaagcaatccggcagacagatgcaaataatcatgaaatcgaggaatcagatatggcattattagagcagtggcagaaagttgcttataatgagaaggcagacagaggagaactgcagagattctggcagagatattttcttctggaaaagggtgtctatgagaagcttctgacgaacccggatgagaaggtagagggaacggtcaaagagcttgcagataaatacggactgagcatcatggatatgacaggtttcttggacggtatcaacgagagcctggtagagccgaacccgatcgacaccatggaggaagatacgaaggtcagcctcgtattcgacaaggagaagctgtacaagaacatggtcgacgcgaaggcagactggctctatgagcttccgatgtggaatgacatttttgacccggagacgaagaagagactgtatctggagcagaagaagtccggaacggttatcgtcggaaagaaagtcggacgcaacgatccgtgtccgtgcggttccggcaagaaatacaaattttgctgtggaaagtaagcacaggaagcagagtgcaagggaagtaccggtatgtggtacttccttttttgtgtaataggcaaattcttcctgctgtggaaaaagaaaaccggttataaaagaaattgctccggagatacttaagaatgggaatgtatcattccagagaacaaggatcgaaaggagaaaagagatatgacattactggattgtgcggtaaccggatgtgcttacaacgaggatcgctgctgctgcaagggcaacatcaaggttgagggaagcgaggcggtgcatcagaatgagacctgctgcggaagctttgtggagcgcggggagaaaagctgcggatgcaatgtaaaagagcatgagtcaaagaagatcgctgtggcatgcgaggcctgcaactgcacgtttaacgagaataagaaatgcagcgcgaaccatatcggcatcgcagggggcaacgcctgttcctgcggcgagacagagtgcgcaagtttctgctgcaaataggagaaaagacggggagccggaggcaatgcaaaacggttccccgttttgcattccggtcattaggctttagcctgctgaatgcgtgtttacgagtttctcaacagagaaacgaagtacgcatgaagcaaaaacccacctgctatgcgggtggagtcaaatcgttatacagaaaaacacctttccgttacaatagagttgttcagtcactattgcaagaaaggaaaggtgttttatggcgaataagtctaatgatctcgcccatacaaaatggatgtgtaaataccatattgtatttactcctaagtatagacgaaaaattatttataatcaattaaaagaggatatacgtgatattctgaaacagttatgtgcatataagggcgtggagattattgaagggcatctcatgcctgaccatattcatatgctagtaagtattccgccaaagatgagcgtgtcgagttttatgggatatttaaagggaaagtcagcgcttatgatttttgacagacatgcaaatctcaaatataaatttggaaacagacatttctggtcagagggatattatgtcagcaccgtaggattaaatgaaacgacaataaaaaagtatattcaagatcaagaaaagtacgatattatgcaagataaattaagtgtgaaggagtacgaagacccttttaagggttaagtcgaagtagtacaaacgcccattcatgggcataagcaacgcgtcaagtgcaatagtgacttgaacgaagagaaagtctagggcgccttgagacgctgtcgggtaccaaggggttacacccagcgtcccgagccaccctttttaagggtggcggcgactggaattttcctcttgtaaagtgcgtctgatggaagtacaatgaaagcaaaattaggaaaaaagtcatgcagtgcagaagggggaaccgatgaatgagaaaaaagtcacatatttcgctggcgcgctatatggtggagaatttaaaggatgaagaattaaaacgtcacaaattttctttttatctgggaagtattctgccggacatcaagccttcgtttctctataagagacacgagatggacggaacgtttccttatgtcagcagacatatcaggcgtctgtcggagggagatgcgctgatccggaagaaaaaggggtgcaagtattaccgggatctgggacagatcagccattatctggcggattattttacatttccgcacaacaccatttacccgggcagcctgaaggatcattgttcttacgaggagaagttaaagcgggacttaagatcgtacctaaagagcggtgaggctaccagacatcaccggctgctgcagcttaaggaagaacatgagaagctgcagaataagaaaaaggcagagccgctcatcgacgcggagacgatctgtgcttttatccagaagtcgcatgacgagtatctggcgcacaagcatggcgtggaggatgatatagaacatattgtcgaggtgaatcacaaagcgctggatgcaatgatgaagttattggcgaataaacgcgccgagtggagaatccggcactcataatgtcgaaaaatgacgggttgttttcgttgattttcgtgttcggacatagtaatataatgaatgtaaggcaggcagtgaagagcagatttatgtgggaatgcccacctttagtgctatgttaacgtcagacataggaatcttagcgttttaaggaggattcatatgaatagaatctatgagttacaaaagaagatcgagacggcgagacacgagttggatgaagcactgttgcaggagaacaggtttgagtactattacgagaaaagcaccagactggacaagctgatagaagaatatcttgagagtcaggagggtgtcagggtctgacaattgaataaacacagtaaacaggacggaacatatatgcgaggcatgtatgcgaggtcctttttttatgcccaaacgcaagttttgggcttttttctattgcaatttggtacaaggtggggtaatattatcatacaagtggaggaaagtggtggagaatggtacaaagtggtggataagttcataactttgtggaaaaccactgaaggcaggtgtttgtgttatgttcatgggagaatacaatcacacagtggacccaaagggcagactgatcgttccatccaaattcagagagcagttaggcagtgaatttgtggttaccaagggactggatggatgcttatttgtgtaccctgccgaagagtggcacaatattgaggagaagttccgcaatatttccatgacatcgaaggatgccagaaagttttcccgttttttctttgctggggcggccgcagtggagctggacaagcagggcagaattctgcttccgccggttttgcgcgaatatgccaatttacaaaaagatgtggtgctcgtgggagtcttaagccgcgtggagatctgggataaggacagatggcaggagaatacctacgatgaggatgagatggacgagatcgcagagcacatggcggatcttggattcagtatctaagcaggaggcgcaggttggagtttaaacattattccgttctactggaagagacaattgaacatctgaacatcagaccggacggaatctatgtggacggaacgcttggcggtgccggacatgccagtgaagtggcaaaacggttatcggaaaagggacgtctcatcggcatcgatcaggatgcggatgcaatccgggctgcgggagagcgtttgaagccgttcggcgataaggttacgatcatccggagcaattacgccaacatgaaagaggaacttcatgcgatcggtatagagcatgtggacggcatcgtgctggatctgggcgtgtcatcgttccagcttgacacaccggagcggggatttacctaccgggacgccgatgcgccgcttgatatgcgcatggatgacagacagagtcttacggcaagggatattgtcaatgactacagcgagatggatctctataggatcatccgcgattacggtgaagataaatttgcaaaaaatattgcaaaacatatagtgaacgagagacagaagaagccgattacaacggcgggggaactgtcggaaattattcgggagtccatcccgatgaaagtgcagaagaccggaggaaatccggcaaagcgtacgtttcaggcaatcagaattgaattgaatcacgaactggaagtgttgcaggacaatctggatacgatgatcgatctgcttaatccgggaggaaggatctgtattattacctttcactcattagaggaccggatcgtcaagacgaattttaagcgcaacgagaatccatgtacctgcccgagtgatttcccggtatgtgtatgtgggaaaaagtccaagggaagagtgattacaaggaagccagtattgccgggggagagagagcttgcagagaactcgagatcgaagagtgcaaagctccgcgtatttgaaagagcttagagtgtagtgagggaagtggcagttatgagaaatgaagcggcagagagaaaatattatattgacgggaatactgtccgcaggatggaagcagcgcctgcagtgacgagaccggatcgcaggatcagagagagccgcccggagcatgtcacaagagagagacgggagcgcgagagacgggagcgggaacgcgagattgaattaagaaacagaaagcgtgcagccagaagaaatcaggagcgtgctctgcgcatgagcaagagctatgtggcatttctcacgatggctgtgatggtgttcggcatctttaccggtgcatacatccacatccagtcggagatgacggcgcgcatgaatcagatatcaagccttgagagccagatcgcagatctgaaagccgacaacgacgaggcatacaagcggatcaatacgagcgtggatcttgacagcatccggaatacggcgatgacagaatatggaatgtcctatgcgaaggaatcgcagattgtgtactatacagtgaacgatgacgattacatgaaccagtacagtgagattccgcgtgagtaggatgacaggagaggcgcatggcaaagaaaaaaagaagaccgctgttgaaatttcccaggcgcatgcaaaaaaagctgattgtcatgtttaccattgtggcaggcatgctgatcggtctgatcgggcgcctgatgtatattgaatataccagcggtgaaaaatatgagaaaattgtgttgtcccagcaggaatacgacagcaaagtgattccttaccagagaggcgatattgtcgatgcaaaggggacagtgatggcaaccagtattgcagtgtacaatgtgatactggattgttctgttttaacgagcgatgaggattacgttgcgccgacgattcaggcgcttgtgcagtgttttccggacttgagcagcgatgagctttacggatatgtccggaatgatccgcagaaccgttatattgtgctgaagaagaaaatatcgtacgacgagatgcagccgttcgtggaactgcaggatgcgacggatgaaaagggcagaaaggtgaaccccgacatcaagggcgtatggtttgagaaggaatatcagagagagtatccgtacggatcgctcgccagcgcggtgatcggatttacggcatccggaaatgtcggagtgaacggtctggagaattattacaacagcacgttaaacggcatcaacgggcgtgagttcggctatctgaatacggataataattttgagaaaacgatcaagcaggcgacaaacggcaacaacatcgtgacaacgattgatgcgaatatccagtccgtggtggaggacaagatccgggaattcaacgaggcgtacacaggcgcctaccgcgaaggggatgcgggagcttcccatatcggagtcctgattatggatccgaataacggggatgtgctcgccatggcgaattatccgaattttgatctgagcaacccgagagatctctccgcgtattacaccgaggaagaactcgctgccatggatgatgacgcaaagatggatgcactaaaccagctgtggcagaacttctgcgtgtcgtatacctatgaaccgggatcgacggcgaagccttttaccgtgtcggcaggacttgagaccgggacggtgaccacggcagacacctattactgcgacgggtatgagacgatctccggtcatgacattcactgtgtcaagagagacggacacggaatggagacattggagcagacgctgatgaattcctgcaacgatgcgctgatgcagatgtcctataaaataggaagagataactttgaaaactaccagcagattttcggatttggtcagaagaccaacattgatctgccgggagagacgagaaccgattctctgatctataccggcgacaacatgacggtggtggatcttgcgacaaacgcattcggtcagaacttcaacacgacgatgatccagcttgccacaggcttctgctcgattgtaaacggcggaaagttctatcagccgcatgtggtaaaacggattacggatgagaacggcaacgttgtgcaggagatccagccgacacttcttcgggaaaccatctcggagagtacgtccgagacgctgcggcagtatatgtattccaccgttacctcaggtaccggagcgacagcgaaagtggacggctactcaatgggcggcaagacgggaacggcacagaaagcgggacgtgacggcgtcaactatctggtatcgtttattggatttgcaccggtcgacgatccgcagcttgtgatttactgcgtggtcgacgagccgaatgcggtggagcagtaccacagctcttttgcacagaatattgtgcgtgagatcttagaggaagtgcttccttacatgaacatctaccgcgatgagcagaccaccggaattcatgcagggtgggacattacgggaacggataccggagcgacagcgatgacggacgttgtaaacgaggagactccggtggaagaaggactggatgtgccggacacaacggataccctgccgggaaatgaagaggaggcggaaggcacagacacgccgcaggatagcggagacacgccgcaggataacggggatgaaccgcaggatagcggagacacgccgcaggataacggagatatcccacaggatagtggagacaccccacaggataacggacagcaataacagacataacctcacgaaaggatgaataaaatttcatggagaactttcgtgaggttttttctatatgtcacaggaacatgcattttaccggagcaagacattcaaccgcagaaaaatatggctgatgttcctcgccgtgtttttcgtgctgatgtttctgggcggacggctcgtctatctgatggtcttctgctcggaatactacgggcagaaggcggaggatcttcatgagagagagcgtgatatcaaggcagcgcggggaagaatcatcgatgccacgggaaaaatccttgcgacgaacaaatcggtctgtaccatttccgtgattcacagtcagatcgatgagccggagaaggtgattgcggcactgcaaaaagaactggggctcacggaggaggaagtgagaaagcgggtggagaaggtcagctccattgagcgggtcaagacgaatgttgacaaggagaccggagaccgcatccgtgcctacggcctttccggaatcaaggtcgacgaggattacaagcggtattaccctttggataccatggcgtccacggtgctcggctttacgggtgcggataaccagggaattctggggcttgaagtcaaatacgattcctatttgcagggaacgagcggcaagatcctcaccctcacggatgcgcgcgggattgagattgaaaatgcgggagagacgcggcttgagccggtgaacggctatgatttatatatttccatggacagcaatatccagcaatactgtgagcaggcggcggaaaaggcatacataaaaaagcaggcggatgaggtgtccgtgattgtcatgaacccgcagaacggggagatcatggcgatggtaaattatccggaattcaatctgaacgaaccgtttaccttaattgaggagatgggagcggatgggacggagtctgcggacaaaaagcaggaactgctgaaccgcatgtggagaaacccgtgtatcagcgacacctatgagccgggttccacatttaagattatcacggcggcggcagcgctcgaggagggcgtggtgtcgctgacagatcagttctactgtcccggctataagctggtggaggatcgcagaatccggtgcgcgaagacaagcggacacggggcagagacgttcgagacaggcattatgaacagctgcaatcccgtcttcattgaactgggcgagcggctgggcgtggaaaactattacaaatatttcaaacagttcggtctgacacagaagacgggaatcgatctgccgggagaggcggcgacgatcatgcataagcaggaaaacgtcggcccggtggaacttgcgacgatctcgttcggacagtcgttccagatcacaccgatccagctcgtgacgaccgtttcttctattataaatgggggaacgcgcatcacaccgcacttcggagtggaggtccgtgagacggacggaacgttggtcgagacattttcttatgataagagagaggagatctgcagcggggagacctcggagaccatgcagtatctgctggaaaaagtggtgtcggagggaggcggaaagaatgcgaagatcgaggggtatgcgatcggcggcaagaccgcgacttcccagacgctgccgagaagcgagcaccgctatatttcctcgttcctcggatttgctcctgcggacgatcccaaagtgcttgtgattgcgattatcaataacccgaagggcacgtattacggaggtctgattgcggcgccggtcgtaaaagaaattatggaaaacatattgccttaccttgataaatcatgaaaaataacgtatactagttgggttaaaaagcacatgttgctttcggcaaagataaaatacatgaggtgtttattatgacgtatgaaattgtaatcccggtaatcgtatcttttgcaatcagtgcattgttgggaccgattgtaattcctttcctgcgaagactcaaagtcggacagacggagcggaaggaactggaatcccatctgaagaaaaacggaacgcctacgatgggcggacttatgatattggcaagtattatcatcacatcggtgttttatgtaaaagattatccaaagattgttccgattctgtttatgaccgtcggatttggtgtgatcggctttctggatgattatctgaaggttgtgctgcgcagatcggacggactgcttgcatggcagaaaatgctctgtcagattgtggtgacgaccgtgttcgcagtttatatgggatgctactcggatgtcccgctcaccatgctgattccgttctccggaggaaaatatttagacctcggctggggagcgttcccggtactgtatctggcggtcatcggaaccgtcaacggtacgaactttaccgatggtctggacggcctcgcgtcgagcgtcaccatcatggtggcaacgttcttctccgtggtggcgatcggaacgaatgcaggcattgcgccgatcacctgtgcggttgtgggtgcgctgcttggatttttgctgtttaatgtctatccggcaagtgttttcatgggagataccggatcactggcgctcggcggatttgtggtctcggcagcctatatgatgcagatgcctttgtttatcgtgattgtcggactgatctatctggtcgaggtactctccgttatcatccaggtgacctactttaaaaagaccggcggaaagcggattttccgtatggcgccgatccatcatcattttgagctgggcggatggtccgagacgagagtggttgcagtattttcgattacaacggcgatcttatgcatgatcgccctgttaggattataggaggaagaacatggatctgacaggtaagacagtgcttgtggttggttccggaatcagcggtgttgccgcgacggaacttctgaaaaagaagaatgtgaatgtggtattgtttgacggaaataaggagctggatcttacggcgcttcgtgagaagcacccggtctttgcggatgtgaagatcatcctcggagaactgacagcggaagatagaagcggactggatcttgtcgtgttaagcccgggagtgccgacggatcttccgatggttgaggatctgaaaaaagacgggattccgatctggggcgagatcgagcttgcctgccattttgcgaagggacggatcgtggcgatcaccgggaccaacggcaagacgacgaccacggcgctctgcggcgagatcatggcaaactattaccgggatgtgaaagtggtcggcaatatcggaattccatatacctccgtggctgcggacaccacggacgagacagtgacggtggcggagatcagcagctttcagctggagaccattcacacatttcacccggcagtttccgctattttaaatatcacgccggatcatctgaaccgtcatcacacgatggagtgctatattaagacgaaggagcggatcgcggagaatcagacggaagacgaggtctgcgtgctcaattacgaggatgaagtcctgcgcgcattcggtgagacgcttcacacgaacgtgctgtatttttccagcagacagaagttagaccgcggactgtatctggacggcgaggatatttactatgcagacggagagaacaccacgaaggtcatcaacgtgaatgaactcaatattttgggaacgcacaattacgagaatgtgatggctgcgaccggcatagcgttaagcctcggtgttccgatggataagattgtcgaagtgctgaagcgttttcaggcagtcgagcaccgcatcgagtatgtgacggagaagcgcggcgtgaagttttataacgactctaagggcaccaacccggatgccgcgatcaagggcatttgtgccatgaaccgtccgacccttctgattggcggcggctatgataagcagtcggagtatgacgagtggattgaaagctttggcggaaaagtcaagctgctcgtgctgattggacagacgcgggagaagattgcagcctgtgcgcgggcacatggatttgagaatattgtgctctgtgatacgtttgaggaggcgatcgacacctgctaccggaacgcggtatccggtgatgcggtactcttatcccctgcatgtgcaagctggggaatgtttaaaaactatgaggagcgcggacgcattttcaaggaatatgtgcgtgccttaaaagaagactaggagtggagaatggcgcgaaggcaggaaaaagaaaaaaaacaaaaaccaattcgatattttgattacagcctgctgtttttgattatctttctgctttgtttcggtctggtgatgctctacagcacgagctcttactatggttccacgcgtttcggggatacggcgtattatctgaaaaagcagctgtttgcgacaagtcttggaatcatagcgatgatcatcgtctcgagaatcccgtaccggttctggatgagagtgagcggtctggcgtatctgatggcgttcggactgtgtacggcggttatctttatcggtacggaagccaaaggacaggcgcgttggatctacatcggaccgctttcgttccagccatccgagtttgcgaagcttgcggtcatcattttcctggcgacgatcatctataagacgtcgaagcaggtgggggattttaagacgctggtcaaggtcatggcgatcgtgcttcccgtcgtcggggtggtcgcatacaataacttaagtacagcgattattatccttggcatcgcggtgtgcatgctgtttgtggcgagcccgaaatattcgcatttcctgattgtgggaggcgtggtactcgcagtcggcgtcatttttatcgcgcttgcatcctaccgcgccgagcgtatccagatctggctgcacccggaagagtatgaaaaaggttatcagacgctgcagggactctatgcgatcggttccggcgggctgttcggcaagggactcggggagagcatgcagaagctcggttttatcccggaggcgcagaacgatatgatcttctccgtcatctgtgaggagctgggacttttcggcgcgatctgcctgatccttttatacctgctgattatctggagatttatggtgattgcgaacaatgcggcggatctctacggggcgctgcttgtggtcggcattatggcgcatatttccatccaggtggttttaaatattgccgttgtgaccaacaccattccgaacaccggaatttcccttccgtttgtcagttacggtggaacttccattctgtttctgctctcggaaatggggcttgcgctgtctgtgtcaaggggaataaagtttgaggttacctaaagtatgattagagaacagagaaaaaagaaaagaagacggaaaatcggactgacggctgcactgatccttctgatgcttctagcgattgcatttctgattgtctggaaagtatttacggtggagaatgtcgtggtggagggaaatgaactctattcttccgaacagatcgagcagctggtgttaaatgatgagtattcgtggaattctctgtatgttcttctgaaataccgcatcagggataccggcaaggtgccttttgtcgacacgatggaagtgacgctggatgatccgcacacggtgcatgtcctggtatacgaaaaaggaattctgggctgcttttacattgacgccatcgggcagtacgcctattttgacaaggatggattcgtcgtggagacttcttcggacgagattgaggatgtgccaaagatcaccggagtgacatgcgatgaggtcgtgctctacgagaaactgccgctggatcagccggatgtgctaaacaaccttctgagcctgacgcagattttgaaaaaatacgaccttctgccgcaggagattcactacgacagcagcttaaaaccgacgctgacctactatggcatacaggtttcgatcggttcggacgactatctgtcgcagaagattgtgcgtctgtcggcgatccttccgcagcttgcgggaatgtacggaacacttcatctggacacatggacaccggacaccacagatattgtgtttgacagagattagaaaatccttaatttgttcaaaaaagtgaaaaaattagttgataaattgaaagaaagaatatattatattgtatatgagtttataagcgggcagtatggattctgcactgcattgaaagacgatatacagaacagacggtgtaggaagaggagcaccggatgattctctgatagatggtgtgtttacatccgtttaccacaggacatgaattatgggagagaatgaaggaggaactaccttgctagagattatgacgacagaagcagataccagtgcgaagattatagtcatcggagttggaggagctggtaacaatgctgtaaatagaatgattgatgaaaatatcggtggagtggagtttatcgggatcaacacggataagcaggcacttacactttgcaaggcaccgaccttaatccagattggcgagaagctgacgaagggacttggagccggggcacagccggagatcggcgagaaggcagcggaagagagtatggaagagctctcctcggcagtgaagggcgccgacatggtattcgttacctgtggtatgggcggcggtaccggtacaggcgcagcgccggttgtagcgaagatcgcaaaagagcaggggattctgacggtcggagttgtgacaaagccgtttaagttcgaggcaaaacagcgtatggtcaatgcgctttccggtatcgaccgcttgaaagagagcgttgatactttaattgtgataccgaatgacaagcttcttgagatcgtggacagacgtaccacgatgccggatgcattgaagaaggcggacgaggtattgcagcaggcagtacagggtattacagacttaatcaacctgccggcactcatcaacctcgatttcgcagatgtgtctaccgtcatgaaggacaagggtatggctcacatcggtatcggtaatgccaagggagacgataaggcgatcgaggcagtcaagcttgcagttgccagcccgctgcttgagacaaccatcaacggtgctacccacgtcatcatcaatatttccggtgatatttctcttatggatgcgaatgatgcggcaagctatgtacaggatctcgcaggcgacaatgccaacatcatcttcggtgcgaagtacgatgagtccatgaccgatgaggctacgatcaccgtcattgcgacaggacttgagaatccgggcgcaacgagcaagatcatgccgaagttgaattatgcaacgcagacaccgaccagaccggtatccggttctacactcggaagaaccacaggaaccgctgctccgacctatcagccgcagggaggacatggtacagtaacaccgcctctgccgggtatccagagaccgcgtcagccggagagcacggtgcagcagatggacatcaagattccggatttcctgaagaattcacgcaaatagaattatagtgacataatatgaactgccatgtgtcagtccgattacaggacttgcacatggcagtttttgtgttgcaggaagattatgtcgaaccaggcagatgactcgccgcattatagagcggacttttgacaaaaaaggagacggcggcatcgtataataggtggcatgtcagagaaaaaccgaggtgaaaggaaatatatgtattttatgcagacgtatttttgatccagaattttctcatggatttccttgctgttgcaggggcaaatctttttttgaagagatgcaggaaaatgcggtggctgctgcttggggcggctgtttccgcagtgcttgggctgtgctgcatcctgctttgccgcaattatctgctgtactgcctgctcacgcattttctcatcaacacactgatgacggtcatctgtttcgggaggtgtgacaggaggcagttctttgagaactgggtggcggtgtatctggtggttcttctgctcggtggggcgttagaatggctgcaggagagcggtattttatcaaaaagcagaggagtagcgatcgcggctgcagtgacggtaacgtgcggtcttctgcggtatcttgggagaagaagagcctttggcagccatgtgcgccgggcatggcttggaaaagatgcgcgccggatggcgttaagcgcttactgggacagcgggaaccagttaagagatccctataccgggcagccgatctgtattttgagctatagtctggcggaaaaatttgtggatcagacaaaagacagaatccggtttgtgccgtaccgtgctcttggagcagaggacggacttcttgcggtgatggatgtggatgagatgatactgcaggatggcaggcagatgcggcggtatgaacatatggcggttggaatcgcacagaaggggttgcttgaggacaaagaatatgacctgattctgcatgcatccctgggatgacagtgaagaaaggagcttacatgtacataaaatggatggtcccggattacgggatgcggggaattttgaacggaatcggacgctttttgttcggggagaatgatgaggtgcactatatcggcggcgcggaggtgctgccgccgccgctggatgcaggggaggagagcgtgtgcatccggatgcttgccacagatgcggcggaggaggcgcggagaaaactgattgaacacaacctgcggttggtggtatatattgcaaaaaagttcgacaatacgggagtcggcgtggaggatctgatctcgatcggtaccataggtctcatcaaagcaatcaatacgttcaatccggataaaaacatcaagctggcaacctatgcgtcgcgctgtatcgaaaatgagattctgatgtatctgcgcaggaacagcaagaccaggctggaggtgtccatcgacgagccgttaaacgtggactgggatggaaacgaattgctgttgtcggatattttaggaacggatgaggatgtgatctaccgggatattgagacggatgtggagcgctcgctgctcatgacagcgattgccggactgaccggcagagagcgcatgatcatagaattgcgcttcgggttgaacacggcgggaggggaggagaaaacgcagaaggaggtggcggatatgctggggatttcccagtcttacatatcgcgtcttgagaaaaaaatcatgggacgcctgaagaaagaaattgtgcgctttgagtagtgccgcccgggattgtgaaaaaagagacataggaaaagaattgtaaccgcagggcattgcgtgtataatggtcttatcaagaaaatgctggggggaatgcatatgaagcttgaatttttgggggctgcacacgaggtgacaggaagctgtcattatctggagtttgcggataagcatgtactggtggactgcggtatggaacagggaccggatctgtatgtcaatcaggagataccggtgaacgcgtcgacgatcgactatgtgtttgtgacgcatgcgcacatcgatcattccggtctgcttccgatgttatataatcatggcttccgcgggcagatttttacaacgacagcgacacatcagctgtgtgagattatgctcaaggacagcgcacatatccagatgtttgaggcggagtggaagaatcgcaaggcgaagcgcgccgggaagccggaggtcgtaccgctctacgatatgaatgatgcggtgggggttctgggacattttgtatcctgcgattaccacagcgtgatcaacgtctgtgagggcttaaaagtccggtttgtggatgcgggacatctgcttggatcttccagtattgagatgtggatctccgagaacaccggtgagggcgtggaggagcgcaagatcgtattttccggagacatcggaccggggaaccgcccgctcatcaaggatccggagtatcttacgtcggcggattacgtggtcatggagtcgacctacggcgaccgcacgcatgagacgccgccggattatgccgtggagcttgcccgcgtgatccgcgatacgtttacgagaggcggcaatctggtcataccggcgttctcggtgggacgtacgcaggagatgctgtattttatccggcggatcaagacggagaatctgcttccggaattccagaattttgaggtgtatgtggacagtccgctcgcggtggaagccaccacgatttttggcaagaatgtgcaggactgctttgatgacaccgcgctcgcgcttgtgcagcagggcatcaacccgatcggttttccggggcttcggatggcgatcaccagcgacgagtcgaagatgatcaattttaacgacaagccgaaagtcattctctctgcgtccggcatgtgcgaggcggggcggatccggcatcatctgaagcacaatctatggagaaaggattccacgatcctgtttgtcggatatcaggttccgggcacgctcgggaatatgctgttaaacggggcaaaggaagtgaagctctttggcgagacgatcgaggtgcaggcgaagatcgagaaccttccgggaatcagcggccacgcggacgtgaaccagctgactaaatgggtgagcatgtttgacccgaagccgaagcgcgtttttatcgtacatggcgaagacaaggtgacggagcagtttgcggcgcatattcacgaggagctggggctggaggcttacgcgcccttcagcggtgatgcgtttgatctgctgacaggcgcctgtgtggcacagggctccagagaggcggtggagaagaagagtacccgcgcagtcaacaatatctttgcaagacttgtggcagccggcgagcgcctgatgacggtgatccgcaagtgcgagggtatgccgaaccgcgaacttggcaaatttgcggaccagatcaatgaactctgcaacaagtgggagcggtaggcattacagggagagataggtgcggatggattttaaggcggatttttcaagacggctgacctgtgcctgggagatgtgaatctcctcggcgacttccatctgtgtctttccctcgtaaaagcggaggcgcaggatgaagttctcgcgctcgttcagatgattcatggcgtcgtttagagagagttcttcgatccagttgtcctcgcggttttttttgtcactgatctggtccatgacgtagagggtgtctcctccgtcggtatagaccggatcgtagaggctgacagggctctggatggcatccagggcgaagacgatctcctcctgggtgagaccggagacttttgcaatctcttctaatgtcggttccttgcaggaggttttggcaagaatctcgcgggtgtggatggctttgtaggcggtgtcgcgcagggaacggctgacgcggatcgagttgttgtcacgcagataccggcggatctcaccgatgatcatcggaaccgcataggtggagaactttacgcccagtgcaggattgaagttgtcgatggatttgatcagaccgatgcatccgatctgaaagagatcatccacattctcgtggtttccggaaaaacgcttgatcacacttaagacgaggcggaggtttcccttgatgtaggtttcgcgggcagtggcatctccctgtttgatgcgtgtgaagagagcgtccttttcctcttcttttaaaacaggcagcttcgcggtgttgacaccgcagatttcaactttgtatgaagacatgatgcgtttcctccggtttgattttctgttaaaaagcatgcttcattcggggcgtttttatacagaaaattttcagcaggaaatgcaaaatgttatggaagtacggcagaatttgtagtataaataaattagaaaataagtggggcaggtcgacagtatatgttggatagaatcgatgagagagacaagcaggaacggatgcaccgcagtattgtaaaatactggaatgtgaattatataccgacaccgtatgcggagccaaaggaagaacagaccggggagaaagaggatgcggttaccgggcagcagcttcctgtggagccggagctgacagtcagctcggcgaattacggcaatgaggaagtgaccgatgaggtgacaaaagggcagatcgacaagattcttcatgagaagacggaggcgatccgcagcctgatcgagcagaacaagcagacggaagaggagcaggatatccctgaagagatggcatccgcgccaatacagcatataatagaataagaacagataccggagacatttatggcagagataacactgcgtaaataccatgggctgggaaatgattatttgatctacgatccgaatcgcaatgcatgtgaattgcaggaaaggcaggtggaagcactttgccggcgcaatttgggagtcggagcagacggcattctctatggccctttttttgatggggacaaaatgcgggtgcgcattttcaacccggacgggagtgaggcggagaagagcggaaacggtatccgcattttttccaaatatttaaaagatatggggtatgtgacagaggagagctatgtgctgcacacaaaagcgggtgagaccagggtgacgtttttaaacgagcagggcgatctcatgcgcgtggacatgggatacccggagtttgtggcaaaggaaatcccggtggtcgggtttgagggggagattgtcaacgaggcgatcttttttggcgataatttctataacgcgacctgcgtctccctgggaaatccaaattgtgtgctgatgctcgaggaggtcagccagaaaaaagcgatgcagcttggcccgtatgtggaaaattccagatattttccgaaccgtatcaacatgcagctctgtcaggtgctcgaccgggaaaatattcagatcgagatctatgagcgcggcgcgggttatacatacgcgtcgggaacaggagcctgtgcagcggctgccgcatcgcacaagatgggatttgtcggcgaccgtgtgacggtgcatatgcacggcggggagcttctggtggaatttgcccgggacggcagaattgacatgacaggaccggtggtttatattgggagcattacgctcgcggagcagttttttgcgtgaaaaattttacgggagaaattttgccgttgccttttttggcagactgtgataaaatgtcagacgttgcgtagcccataaaaacaaggtctaagcgggcttgccgccgatttccggcgttaaatgaatcgagtgttcgagaccttccactcgtaaaacaaaactaaaggagaacagaatatgagaaactctaaggtacaattcattgtgcacgctgcgatgattgcagcaatctatgtcgtgctgacctattttatcagtgcgttcaacctggcatcgggagccattcaggtccggatttccgaggcgctgaccattctgccgtactttacaccggcagcaattccgggactgtttgtgggatgtctgcttgccaaccttctgacgggagcagccatctatgatgtgatcttcggcagtctggcgacgctgctcggcgcagtcggaacatatctgctccgcaagcacaagtttttatgcacgctcgcgccggtggtatcaaatatcatcatcattccgctggtactccgctacggatatggacttaccatggaatatggcggaagagactggtcgattccgttttacatgctgaccgtcggagcgggagagatcatctgctgctgtgtgcttggaacgattcttttgaatgcactcgcaaaagtgcgcaatgcaatctttaaaaaagaggattagattagaaaacaccagctataggaataacctataactggtgctttttttttcatattagacaggttggttttctcatgttatcatcagattatcaacagacagaacttccaaaatgaaaataaaaggagaaacataacatgggaaaagcattaaaggacagaaagttaaaatttgagacattacagcttcacgtaggacaggaggaggcagatccggtgaccggagcgagagcagtgccgatctaccagacatcttcttatgtatttaacaacagtgagcatgcggcggcgcgtttcggactgaccgatgcgggaaatatctatggcagattaacaaacccgaccgaggatgtcttcgagcagagaatcgcagctttggagggcggtgtggcagcgcttgccgtggcttccggtgcggcggcgatcgcctatacactccagaatctggcgcatgctggcgagcacatcgtggctgcaaacaacatctacggcggcacctacaatctattggcacatacattcccggagtatggtatcacgacaactttcgtcgatccattcaattacgacgaggtggagcaggcaatccaggagaacaccagagcgatccacattgagacgctcggcaacccgaactcggacgttgtggatattgagaagatcgcagcgatcgcgcatgcgcatcagattccgctggttgtggacaacacttttgcaacgccgtatctggtccgcccgcttgagtacggagcagatattgtcgttcactcggcaaccaagtttatcggcggacacggaacagccatcggcggcgtgatcgtggacggcggaaagtttgactgggaggcaagcggcaagttcccgtccttgacggagccgaatccgagctaccacggcatcagttttacaaaggcggcaggaccggcagcgttcgtcacaaagatccgcgccattttactgcgcgacaccggtgcaaccatctctccattccactctttcctgtttttacagggacttgagacattgtcgctgcgtgtggagcgccatgtggagaatgcattaaaggtcgtagaatatctgaacaacaacccgaaggtggagaaggtgcatcatccgtcggtatcggaggatccggtgcagcaggcactctacaaaaaatattttccgaacggcggcggttcgatctttacgttcgagatcaagggagatgagcagactgcaaaggatttcatcgatcatctggagctgttctctctgcttgccaatgtggcggatgtgaagtcgctcgtgattcatccggcatccacgacacattcccagcttacgacggaggaactgttagagcagggcatcaagccgaacacgatccgtctgtcgatcggaacggagaatgtggacgatattattgaagatcttgcggaggcatttgcggcagtatgagattattgattgtacggcacggggatccggattatgagcatgacaccctgacggaaaaggggtggcgcgaggcagagcttttggcagaacgcctgtcaaagcttaatgtcaaggagttttatgtgtcgccgctcgggcgggcgaaggatacggcgtccctgacgttacagaagatgaaccgcgaggcaaacgaatgtctgtggctcagggagttcgacacgaagatcgaccgaccggattgcccggatcgaaagtcgattgcctgggactggctgccggaggactggacgagagaagaggagttcttccggcgtgacctgtgggcgacacagcaggctatgcgtgggggactggctcccggcgcgcatgagggaaacggcgtccgtgtgcaaaagaaaccggacggtggcgtaggtgcagagtatgcctgggtggtatcaaactttgatgccctgctggcggagcacggctatgtgcgcgagggcgacatctaccgtgtcgcacaggcgaaccgcgatacgcttgtgttcttctgccacttcggactggagtgtgtgctgctgtcgcacctgatgaatgtgtcaccgatgattctgtggcatcacacctgcgcggcgccgacgtccgtcactacggtgtataccgaggagcgccgtcccggcgtggcatctttccgtgtctgcgggttcggagatacctcacatttgtatgcgggtggcgagtctcctgcattttcgggaagattttgtgagacctatgcgtgtgatgaggaacggcacgattagaaaacagaaggaattgtcataataagcatagaattcttttgggtaattagtaatattattagaagatcacaccgtgggatttcagatgaaaatgcagagggaaattcgttggagaaaaatgtgagcatttcttccggctgaatgtctgcatcggatttcgtgtctcttctacgtttggacaatccgacgggtgcatgtccgacacaccggagacaatgggcggactttttagacctgttaagagatgtcaacacaatttttgatttttttgcataagaaataggcctgattattcaggcttttttcttatgcaactatactatattcttatatatttccattactcttgcataatagatttgcaaaaacttatttaaaccggctattttggcttgtttcttactttttccttcattctcttttttaattataaaatcatagacacgagtatctgttttgggcggatgggatttcagacttttcataacctcataaccggttttccttaatgcactgtttccgcgtttgcttattctacgtttggtgccggtatattgtcctgattgataaggcggagcatcaattcccgcataagcaactaatgctttgccattatggaaacgtcgaacgtctccaatgtcagctataaaccttacacataacttttcacccatgcctcccatttggcgtatcgtttgatattctggtaaagtctttgcaagattttgcatttgtgataatatttgttctagagcataacctaattggcttacttgctctgttgctacttccatacagagtctggttgaagggaactctgttggtagtgtagggataccgtcttccgccaagtgaaaaagctcgtctgccttttctgattggaaacggtatcctttttctttacaccattgcttataattctctcgaaaaatttcttttcccatgctttttatcatatcaacatgatagaattctttggcaaaatccacatatttcacttttgagaattgaacactgcttgctgtatccagcgcttctttgaaaccaggaagcatctcatccatcaaatgtattacattctgtttagcaacaatcaaaagctttatgtatgtctgatactgcttggataatagacttaattctgtgtagcagcttggatgaaatttatatggtttcagttcactccagtatgccaaaccgtactttgctaatttttttgcatcaagcggatctgtttttgcgccatgcagcataatgcgtgaaaattgtcgtataatatatgcattttcaacacatacaaaaaagcctttttgatacagaaattgtgcaaccggaagatgataatgccctgttgattccattacaatacgaatttctccatcaagtgatccgatgtaatcagctaacattgacatttcttctacggtatgcaaaacttcaaacgattccttaataatcgtattaggatgtatcatggcacagacagtgcttttcccttttgatacatcgattcctacacttactatttgtttcatgcaaatcctccttttctccgccagacttattaccattcagacttgttcgttacacggatgtatttaatccaacctgtttaaacgaatgcttataataagaggcggaataaactctaaaaaacgggagctatgtcccaccgcactagccttatccgccttttattataataaaaataagcatgcggatacatacataatgtatctacatgcttatagtacaagccgcactagttgtactccctcatagacaatataaaaccgcgcgaaccgaaactcgttgtcatctgctattaaaaatatggcagatggcaattcagacatcggcttcgcgcggttatgttttattgcgggagtacaggcaagtgcggcacaaaagtcctacaaattgtctcccgggatgcggacatgacccgcggagtgctccaaacttggaaaaacacggatcatcgaagatgcagacatcaggctggctagaaatgccacattttttgaaccgaatttccatctgtatttccacatgaaatccacaagtgcgtttcttataatattattgcttattaaagcatgatatgcttattgtgacagttcctttgtgtgataggaaatatgtaacctgcagttacatggaaatccacccgaatgcattggcaactgagcttgcaagaatgatcatggtgaaaaccgggcataagtatttgatcatcaaaacaaaaatctttttccggcggaaggtgccttccccgtgcaggatttcttcctccatgcgatcgattccgattaccctggatacaagaaggcttgtcatcaaggcagcgaccggcatcatcacggagttggtcagaaaatcaaagaaatccagaaactgcatgccgatgatccggatgtttgctaacggaccataacctaaggaggagaggcttccgagcgcaatcatgatcacgccgaccaggacggtggatttcctgcggttccatccaagttcgtcctcaaaggtagagaccgcgctttctgtcagtgcaatcgaacttgtcacagcggcaaaaagcaccagcagaaagaacaggataccaacgaaagtgccgagtcccatattggcaaatacttttggaatcgtgatgaacatcagcgccggacccgcctgcagcgtgtccggatcgccgcctgaaaatgcaaataccgcggggataatcataagtcctgccataatcgcgatggcagtatcaaaaatttcgacgttcttggtcgatccctcgatggaagtttcctttttcatataagaaccgaaggtaattaagattcccatggcgatggagagtgaataaaacatctgccccatggctgtaacaacagtcatccacgaaaaattcgccggattcggtacaagaaaatatttcacgccggcaagcgctccaggtcttgtcacagaataaacggcaatgatcacggacagtacgacaagaaccggcatcataagcttggaaacacgttccactccgttacggactcctgcaaaaataataaccagcgtaaacatacagaagagaacgaaacagagctccgtcgatgcgccgtctgagataaaggcggaaaaataaccgtcttctgcaagcttagccccgtctccgcggatgtattcaagcaggtatttgatgacccatcctccgattacagagtagtaggggacaatcaggatcggaataatagcgttgatccatccgccgaaggaaagccatttttttgtcccgaaggactggaaagcactgactggacttttgcgcgtcatccgccccagggcactttctgcgacgatcatggtgtagccgaatgtgagcgctaacagaatgtagatgagaagaaagattccgccgccgtatttagcagccagatacgggaatctccagatatttccgagacctacggaggcgcctgcggcggagagtacaaagcctatttttcctgagaaggaacttctgttgtctttagaattcataattttatcctctttgatgtattgtgtgtaatgagagcacacaaagcctattttagcatagatggcagagaatgtcacgatagcccggtatctttttcgtgttgtttcacttgagaaatggtctgtttatggtataatgtgatacaggttgtaaagaaacagtttgaacgaaatgcaggagagaagaatatgaaaaagatcttagaccttatcaccggggaagtcacacaggcatttgtggactgcggttacgatgcaaagtatggcaaggtgacattatccaatagaccggatctctgtgaatatcagtgcaacggagcgatggcggcggcaaaggagtacaagaaggcgccgtttatgatcgcggacgaagtggcggagaagctttccgggaatgccatgttttccatggtggaatctgtaaagccgggatttttgaatctcaagctggatgaggcatatctggcggattatgtggcaaagatgcaggcggacgagggaagatacggctgtgagaagaccaaagagccgaagacgatcatgatcgattacggcggaccgaacgtggcgaagccgcttcacgtcggacatctgcgctcggcgatcatcggcgagagcatcaagcgcatcggacgttttatgggacatacggtgatcggcgatgtgcatctgggcgactggggcttacagatgggacttatcatcacggaacttcgggagagaaagccggatctggtatattttgatgagaactataccggagaatatccagaggaagcgccgtttaccatctcagagctggaggagatctacccgacagccagcggcaagtccaaggaggacgccgcctacaaggaggcggcgatgcaggcaacctacgaactgcagcatggcagaagagggtatcaggcactgctttcccacatcttaaacgtttccgttacggacttaaagcgcaactataagaatctgaacgtatcgtttgatctgtggaagggggaatccgatgcccagccgtacattccggatatggtgcagaagatgaaggatgacggatttgcctacatcagcgacggtgcgcttgtcgtagatgtcaaggaggataccgataccaaggagatcccgccgtgcatgatcttaaaatcagacggtgcatccctttataatacgacggatcttgcaacgattgtatggcgtatgaaggactaccatccggatgagctgatctatgtggtggataagcgccaggaactctattttacgcaggtgttccgctgtgcgcgcaagaccggactggtaaagcctcggaccggcttaaagttcctcggcttcggtacgatgaacggcaaggacggcaagccgtttaagacccgtgagggcggcgttatgcgcctgcagtatctgcttgagagtgtgaacgaggaaatgctcaagaagatcacggagaaccagaaggcaaaggagaaccttgagatcagtgaggaagaggcaaaggagaccgcgaagatgatcgcgcttgcagccatcaagtacggcgacctctccaaccaggcaagcaaggattacatcttcgatattgaccggttcacctcgtttgagggaaatacgggaccatacatcctttacaccatcgttcgtatcaagtcgattctgaacaagtatcacagcatggggaaggatgagagcggtgcagtgattgaggcagctcattccgcgagtgagaagaaccttatgctggcactttccggattcggcgccatgatggagaacgcgtatgaggagacagcgccgcataagatctgttcttacatctatgagctggcgaatgcattcaacagcttttaccatgagacaaagatcatgtccgaggagaacgagcagatccagaagtcttatatccgcctgttagagctgacaaagtcggtacttgagacctgtattgatctgctgggctttcaggcaccggagcgcatgtaacctatttagtgagctgataaaaaagaaggggctgccgcatgaaacgggctgccccttcttttttgcgcttttttatgaccgacgcaaaaaccagtcatattttttcggacaggtcatagaattagacatagccggaaagggggcatggctttggagatcgtcaaaatattcccggtgcatataagagaggcgctggcgaacgatacatggaaggcgggactggaggagatccgtgtccgggtgggcagtccgcttgaatttatttacggcggggagagccgctacctgccggggcgggagggcgcgtatgcactgccttctgcctgcggatatgagaacggctatcggatgacgccggaggaccttcgtgagatgctcaactatatcagcgattattcactctacgcctacagtgaggaggtaaaggagggctatcttaccatcgagggaggacacagaatcggaatggcgggacaggtggtaaaaaaggatggaaaagtgacgggtcttagccatatcacctttttaaatgtccggattgcacacgagaaacggggctgcgcggatgacattcttccgcatatcaggagatcggacggtatctataatacactgatgctctcgccgcccggaatcgggaagacgacgtttttgcgggatctgatccggcagttgtccgcgggggatgcgggtgcacccggaatgaaagtgggggttgtggacgagcgttccgagattgccgcatgccacctgggaattccgcagaacgatctgggcccccgcacggatgtgctggacggctgtaagaaaacggagggaatccggatgctcctgcgctccatgtcgccgcagattctggcggtggatgagcttggtggaaaggaggattttgcggcggtaaaacaggcactgtgctgcgggtgcagggtactcgggaccgtgcatgcgggctgtgtgcaggagcttctggacaaaccgtatctgcaggcatgcgtcacacagaagctgttcgggcgctacatattgattgaacggaattcccgcggggagcgcagcaccacaatctatgatgaacggatggagcggatatgttaaaaatcatgggaagtatcctggtctttgccgcggcggcggggatggcaggcacatacaaaagagaactggcagaccatctggcacttttgtacgcgctgcggaaacttctggtggatctttcctgttacggaaatggaaccagacagccggtggaagttctgctgggatgctttgtgagaacgccggatgaacgattaaatgagatctgtcggaagattgcagactgcctgatagagaaaaacgagaaaaacggggaacaggtgtggaagagggtttttgaggaatatcggaaaaaactgtgtttaaccggagaggagagcgcgctcatcggggaggcgggcggcgcgcttttcgggagaagcgaagaagaaaatcacagaagactcacgctcattttagaacagctggatgacaggatcaaaaccgtgcggggagagcttggagaaaagcagaagatttatgcgactgtcagtatggtgatggggggaatgctcgtcattcttctgatttagacggcaggaaagcaaaacagaaaggaaagaaatacgatgagcgtgaatttgatttttaagatagcggcagtcgggattcttgtgacagtgatcggacaggtcttaaagcacagcggcagggaggagcatgcgtttttgaccagccttgccgggcttatcattgtgctgttctggatcgttccgtatatctatgaattatttgagacgatgcagtcgctgtttgcgctgtaagccgggagaaaacgatggatattgtaaaaatagcggttcttggcatcgcgggagtatttcttgcaattccgctcaagagagaaaagggagagtacagtacgtttgttgcaatggttgtgggaatctgcatttttatctatctgctcacaaaggtggagactgtactgctctttgtggattccatcaagtcgcagcttccggtcgatggcagatacatcgggctggtggtaaagatggtgggaatcacgtatgtggcggaatttgcggcgaacctgtgcagggattccggttattctgcgatcgcaggacagattgaaatgtttgcaaagctgtccattctggtggtgagtgtgcctgtgtttggagcatttttggacgcggtggggagttttttatgagagagtgtggaaagagaagcttctgtctggtgtgcatgtttttggttttgaccggaatgcctgtgactgtgcaggcggcagattatgacggcgggacggggagcgcggagaagacgcaggagacatatttaaaaacgtttctggaagatctggactttgcggaactggatacgtggaccaaagaggagctgtttccggagcagagggaaaaattcagcttctccgtgatggtgcaggaactgcttgcggatggaatcggagtgacctccatggaaaaaatcggacagtggctgtgtgatgccctgctgtatgagataaagaccggcaaaacaattctggtggaggtggtgctgcttgcagcgggtttttccatgcttaagaatttctcgggaacctttgagaaaaattatgtttccgacatctgtttcctgctggtctacggcgtgctctgtgtgctgctgctaaagtcttttgaaatctatggaacggtagcggaagaagcgctaaacggcagcatcgattttatgaaggcactcattccggcgtttggcatcagcatggtattttcctcgggggcggagagctccgccgccttttatcagctggcgtttctggtcatttatctggtggagtggctctttctttcggtgctgcttcccttcatccgtgtgtatgtggtgacggagctgttcaatcactttttcgaggatgaaaaattccagaattttacggaattattggctggagtgatctcctgggggatgaagagcgcgatgatggcggtgctcggattaaacgtcatgcagggactgcttgcaccggcaaaggaccgccttttaaacggagcggtcagccgtgcggcgatgatgattccgggggtggggaatgtgcttggaggaatcggggagcttatgttcggcgccggaatactgatcaaaaactgtgtgggggtgacggcactgatcgtgctgcttgcggtgggctgcatcccggttctaaagcttgcctgtatgtcagttctctataaacttgcggcggcggtggcggagccggtggcggataagaggattgtcggatgcattaagagcatggcgcagggaggcgtgctttatctgaagctggtctgctatggcattgtactgttttttgctacgattgcgctgcagacggcggcagtcacatcacatgcatagggggacgtgccatgaacgcatatatgagaggatttgtcattctgtttgtgcttctggtgctgctaagttatctgccgccggggaaacaataccggaaatatatccgtttttacgcgcagcttctgatggtgcttgcagcattgagaccgctgtttgtactgtttggcggaaaagatacgttttatgaaaaaatggcatatgcccagtgcatggaaaaactgtcggaattttcccgcgatacgcagaaaatcgcttatctgaatcaggacagataccgcacagagtatgagaatgtcatcgcggaaaatatcagggagaaggtggatgatatgctgcaggagtacgggcttggcacccagagcgttacggtggaactgggggaggatcatacgatgcaggagatttgtatttacatcacagatgagaacgcggatgagatttcggtcggaagaatcagcgtgtcagatgcggcagagtcaggggagaaccaggaggtctgcgggaaagtaaaggaagaactggcggcgtactacgggatggaggattccggaatacgggtgaattatgtgggaggaacgtaaatgcctgaaaaactgaaacggatcttacagaacaaaaactggcgcagctggaagaaaagcgactggctgctgctcgcgctggcggggatattattgcttgtgattgcactgccggtggagagtggggatggcacagcagaaaaggcatataacacggcacagggggaaaaggagacgtcaggcggcagcggaagaacggcgtcaggagatagtggagggacggcgtcaggcagccagacatcggaggagggagagcaggaatatgtccaatatctggagaagaagctcgagaatattctgatgcagatggacggggtgggcagagtggacgtcatgattaccgtttcagacgggggcgaacagattgtggagaaggacaaaaagacaacttcctcttcgacgggcgagcgtgattccggaggcggggagcgcagtgtgacagaacaggcgggggaagattcgacggtatacgtggagactgcagatgaaaaatatccgtatgtacagaaagagacgctgccgacggtggcaggcgttgtggtggtcgcagagggaggcgggaacccggcggcggtttctgagatttcagagtccgtgcaggcattattaaaggtggaaccgcataggattagagtagttaagatgtgttccagggaggaatcggagtgaagaaaatatttcggaaaaaccagctggtgataacagcattggcacttatgattgcggtggcaggatatttcagctacatgaacaacaatatggaagatggccaggtgacggcggaagcgagcgcggatgcgggaacggtgcaggatacatacgacatatcggaggaggatatgcttgcggagcaggagatctttaccgatgagggaaccggggaggaactggcgcttgtggaaggaacggagacggcagcagtggatgccgcgcagtccggggatgtggcacagatgacggacggtgccgcggacgtcgagaatcctggggaggcggtgcttacaagcacgacgattgcgaacctcgattatgcggcggagatgaaattaaaccgcgagcagatccgctccaagaataaggaatccctgcttgagattgtaaacaatacgacgatcgatgagagcttaaagcaggatgctgtcaacaagatgatcgccatgacggatattgccgagcgggaggcagctgcggaaatgctgctggaggcaaagggattttccgatgtggtggtgagcatcacggaagataactgcgacgttgtcttaaatatgggagaggtgacggatgcaaagcgggcacaggtggaagatattgtaaaacgcaagaccaacattgcggcggataagattgtcattaccccgattgtggtggatgagagcggggaataagcttaaaatactggtaaaagaggcggatatgtagtataatctccatgctatttgaggcatggagatttttttagattggagtaagctatggcaatgcgcatcatgatacaggggaccatgtcgaatgcgggaaagagcctgattgcggcgggactctgccgcattttccggcaggacggctaccgggtggcaccctttaaatcacagaatatggcgttaaattcctttatcacaaaagaagggcttgagatggggcgggcgcaggtgatgcaggcggaagcggcggggatggaaccgacggtagcgatgaatccgatcctgttaaagccaaccaacgacatcggttcccaggtgattgtgaacggcgaagtgatcgggaatatgagtgccagggattattttgcttataagaaaaaactggtgccggacattcttgcggcgtaccacaggcttgaggagcaggcggacatcattgtgatcgaaggcgcgggaagcccggcggagatcaacttaaaagagaatgatatcgtgaacatggggctggcggaacttttgaatgcgccggtgctgatcgccggagatattgaccggggcggagtgttcgcgcagctgctcgggacacagcttcttctggaggagtcggagcgcaggcgggtaaaaggatttatcatcaataaattccggggcgatgtgtccattcttgcgccgggaatccggatgctggaagagcgcggcggcgttccggtcgtcggggtggtgccgtacatgcagatttccctcgaggatgaggacagtctgacgacccggtttgatgcgaggcaggaggcggcggtcgacattgcagtgatacgttttccgcgcatctccaattttacggatttctcggtatttgagcagtttgaggatgtgtcgctgcgctatgtcgattcggtggaaaagctgcatcatcccgatatgattcttctgccgggaagcaagaatacgatggaggatttaaaatggatgcgccagaacggtctggaggcagcgattcttcacagaagcgcggagacgttcatttttggaatctgcggcggctaccagatgctcggaaaacagattgcggacccgcacggcgtggagacgggcggtgtgatccggggaatgggattacttccggtcacgacagagctgggggaacagaaagtgcgaacccgggttggcggagagattcttggcgggatgctggacggatgtgaactgagcggctatgagattcacatgggaatcagcagaccggagggggactgcgaacctttctgcaggatccgcgacgagattaccgggaaggaacgcacggacggcgtctttgcgggaaatgtgtgcggcacctacgtgcacggcatttttgaccatggctcaatcgccgggaagatcgtgcggcacctcgcagagaggaagggactcgtgctcggggaggacggcgtggactacggattgttcaaggagcagcagtacgacaagctggcggcaacgctgcgcaagtatctggatctcgatgcgatctataagatgatgcgggaatatgagtgacaaaagagagaggtgtgtgggatgttagacagacagcagatgagacagttgaagatagagccgccggatcaggcggtctataaggaagtcctcggcaactgggatgcgcttgcaaagccgctggacgggatgggagaatttgaggaattgtttgcccgcatcggagcaatccggcgtgatcccgcccttgatatttccagaaaagcagtggttgtgatgtgtgcggacaacggaattgtggaggagaagatcagccagtccggacaggatgtgacggcgaaggtggcggcagccatggggagagggacgagctctgtctgccggatggcaaaagcagccggcgtcgaggtaataccggtggacatcggaatcaacgaagagggatcgccggagggcgtgctgccgtgcaaagtgcgtcgcggaaccagaaattttatcaaggaacgggcgatgacggagcaggagacactggcggcgattgagattggcatggagcttgcgaagcggcttgcacacgagggctataagctgcttgcgaccggtgagatgggaatcggcaacacaacgaccagcagtgcggtggcggcggcactgttatcctgcgatccgaaggagatcaccggaaagggagccggactcagtgacacggcgcttttacgcaagattgcggtggtcgaagagggaatccagatgcatgaactctatcaggcggacgcattcgatgtgctgtgcgcagtgggcggactggatatcgccggactttccggcgtgtttatcggcggtgccctggcacatgtaccggtggtcgttgacggagtcatcagtgcggtggctgcgcttgcggcggagcggatgattcccggcgtgcgcgattacgtgataccgtcacacaagagcagggaaccggcggcggagcgcatattggaaaaactgggaatccgcccggtgttagatgcgggactggcgctgggagagggaaccggagctgtgatgatgtgcggactgctggacattgcgcggacgatctacggcgagcgcaccacgtttgcggatattgatgtggcaccgtatcacagattcgggtagcctcagagaggagtaggacatgattctggtgatcggcggaagcggcagcggaaagtcagcttatgcggaaaaagtggcattggagtgtcaaaaagagaaaaggcacttctacctggcaaccatgcatgtgttcggcgaggaagggcaaaaaaaggtgcagcgccataaaaggatgcgcgcaggcaaaggctttgtgacgatcgagcagccgacggacatcatgcagtgccttcccgcacttcgggaggccggtggcggcgtggtgctcctggagtgcatgtcgaatctggctgccaatgaaatgtttgacacggaagaaccggcgggcagtgagcaggtcgcggaaaagattgtcacgcagattggcgtgctggcgcaggagacggaagaacttgtcattgtcaccaacaatgtgtttgaggatggcatcgtctatgatacttccaccatggaatatcttcgggcgctcggcagcatcaatgtgagactggcagagcgttcggacgttgtggtggaagtgattgcgggaattcccgttgcaagaaagggaaagcttccggtagcggtggcagagaaacagggacacagacagaaaggagcaccggcatgtccgtgataaagtctttttttatagcattttcgatttattctaaaattccggtgccgcagttcgcgtggaaggaggaggacatgcgctatacgctgtgcttcttcccgtgggtcggagcggtgatcggattgtgtttcctgttgtggaaccggttcgcgggcgtgtatgggatcccgtccactgcccgggcggcggtaggagcggttctgccgcttgcaatatccggcggatttcatgcggacgggtttatggacaccatggacgcgctgcattcttaccgcgacagggagcgcaaactggagattttaaaagattcccacatcggcgcgtttgccgtgatctgttttgtgatgtatgagctgatctatctgggagcagtgtccatgatcacggaaaaagaacagattttagtacttgccgcaggcttttttttgtcgcgcaccttaagcgggatcggtgtcgtatccctgcgctgtgccaagacgaacgggatgctctatcagttcgcgagcgaggcgcaccggcgggtggtgctaacggcgctgtatctgcagcttgtactctgcgtcgggctgatgcttgccgtatcggtgaaaaccggtgctcttgcgtgtgcggcagcagggcttacctacgcgtactacagacagaagagttaccaggaatttggcggtattaccggagacctcgcggggtattttgtgacgctgtgcgagggtgtgatggcggtgcttgtggcggcggcagggctgatcggctaggaatgaagcattgcgggatgacgcatcagaaaggataacacatggaactatacattggcggatatgcacagggaaaacttgcttatgtcaaagggaggcatccgggggaaaaacatccggtgtgggacggagccacagagacgtttaccgggagaacatccaaggaggcgccggtctgtaaccactaccatctgtgggtgaagaggctgcttaaggatggagcggatgtaagagagctgaccggcaggctgcttctggaacacccggactgcatcattatcagtgatgagatcggcaacggaattgtgccgctggaccatgaggagcgcgagtaccgggagacgaccggcaggctgctgtgcgggctggcagaaaaggcagaccgcgtggagcgcattgtgtgcgggatcggagagcggatcaaatgaggtatgaggcagacatggcactgatccgtcacggtatgacgcccgggaatgaagagcaccgctatatcggaagaacggatgagccgctttcacaaaaaggcagagagcagcttctcacattgcagaaaaaaggcgtttatccggcggcagcatgcgttgcggcaagtccgctggagcgctgcagacagacggcagagctgttgtaccccggacaggcgccatgcgttttcgatcagttccgggagatggattttggcgcgtttgaagggcataactatgaggaactgaaagcggatgtccgctatcaggcgtggatcgacagcaacggaacgctgccgtttccgcaaggggagagcagagaacagttccagagacggtgcgtggagggattttgtgagctgcttaaggaagtgtggacgcgggagaagcttccggcgtcgcttgcactcatcgtgcacggcggaacgatcatggcgcttctggacgcttttgcggagggcagttattacgattaccagtgcgcaaatgcgaaaggatataaaggacgactgtctgtggaatttgatgcagcgggaaatactttaagagacacgataaaaattgcggatgtgagaaagttggaggaatgacatgctctcggtatatcatatgacggcgtttacaatcggatttgtgatggatctgctgttcggcgatccgtactggctgccgcatccgatccggtggatcgggcgcctgatcggatggctggatcgaaagctgcttggagagacagacggcgcggtgcgaaatgaagccgccgagaagaaaaagggaaggtggcttgtggcgttcgtgcttcttccggtactcttttttgcggcagcagtcctgtttgcggcgtaccggatccatccggcggcgggggttgttacagagagtgtcatgacctaccagatgcttgccacaaaatgcttgaagacggagagcatgaaagtgtacaagcagctttcggagcatgatctgtgcggggcgagaaaggcagtctccatgatcgtcggaagagatacggaatgtctggatgaggagggcgtggcgaaggcggcgatcgagaccgtggctgagaatgcctccgacggagtgatcgcgccgatgctctatctggcgctgtttggaccggtgggaggttttttttataaggcggtcaacaccatggattcgatggtgggatataaaaatgacaggtatcacgcatttggcacggcggcggcaatgctggacgatgttgtcaatttcattccggcgcgcatcagcgccatgctcatgatcttatcctgctgtttccttggaaacgaatttgaccagaagaatgcgatgaagatttttaagcgggaccggtatcagcatgccagcccgaactccgcacagaccgaggcggcatgtgcgggagcgctcggcataagactggcaggagatgccagctattttggaagaatcgtcaaaaagccgtacatcggtgatccgctcagagcagtggagacagaggatatcagacgtgccaaccgcctgctgtatgggatggcatttttcggatggggaatttgtatggctgtctggttgtgcgtgacagccattgtgtggtagcatagagacagaacaggaggaagaaccgggatggtgcagcagaacatacatggaggagacatataccgcaatcaggtatcgcttgatttttcggtcaacatcaatccgttcgggatgccgcagcgggtgcgtgaggcgcttgaggcggcagtggcatggtgtgagcggtatccggatatccggtcggaggcattgcgggatgccatcgccggggcaaaagggattgcgcctgcggatattgtgtgcggaaacggtgcgtcagaactgtttcctgccattttaagagcggttcatgcgaaaaaggtgctgcttcctgtaccgtcattttacggatacgagtatgcggcaaagtctgtgggagcagagatctgctgccacgaactgcttgagacggacggctacgcggtgacggagcgctttcttactgccatcggggagggtgtgaacgccgtttttctggcagtcccgaataatccggtgggtacggtggtggagccggaactgttggagaagattgcagagcgctgtcagaagtacggtgtgaccctgattctggacgaatgttttgtgatgtttaccggagcggaagaacgctattccttcttaaaaaagtatcggaattatccgagagttgtgatcgtgcgggcatttacgaagctctatgccatgccgggagtgcggctcggctatctcgtctgcagcgatgctgctcttacggaagcgataagagccgatctgccggagtggaatctgtcggtgtttgcgcagcaggcgggatgtgtggcctgcgggcagcgcgcgtatgtggagcactcggtggcatttgtctgcagggagcgtgcctggcttacggagcagctgtcggaaattggcattactgtgtttgcgtcaaacgccaatttcctgatgataaaagacgggcgtccgctggcaaaagagctcttaaagaaggggattctgatccgcgactgcagcaactaccggggactttccgggggatattaccggattgcggtcagacggcgcgaggagaatgaacgcctgcttgcggcgctggcgcaggtgacgggaagcagcgtggtggaaaacggcaaagatgataaaaagccggcagcagtgcccgacggaatcgagtatgtgatgccacaggagatagagaagcgcagcttttccatcatcgaggaagaattgcagcttcgggggattacgctgcctgtggaggaagcaatggtcacgaagcgtgtgatccacacgagcgccgatttttcctatgcgcagacgatgacctactccgcgggagcggtggagacggcaaagtggctcatcacagagggcgcggacattgtgacggacaccaacatggcgctctccggcatcaacaagcgcgtgctcgcacgctacggcggatcggtacactgctttatggcggacgaggatgtggcaagagaggcgaaggagcggggcgttacccgcgccaccgtgagcatggaacgggcggcaaagatcgaaaaaccggtcatctttgcgatcggaaatgcgccgacagctttaatccagctatacgggatgatagaggagggctaccgcccagcgttcatcatcggcgttccggtcgggtttgtcaatgtggaggcggcgaaggaactgattttacagacgaagataccgcatattgtaaaccgtggaagaaagggcggcagcaatgtcgcggctgccatttgcaatgcgattctctacgagcttgggaggtgagcccatgcgctatggatttacgacgggaagctgcgccgcagcggcggcaaaggcggcggcttatatgcttcttaccggcagagaaaagcacgagattaccatcaccacgccaaaaggcatcctctaccatgccaggatggaagagatcagccgcacggagcattccgtgcgctgtgctgtcagaaaagatggcggagatgatccggacatcacgacgggaacactgatttttgcggaagtatcctggcaggagcagaaacaggaaaaagactgcggaaaaccgcagattcttattacgggaggcgcgggtgtcggaacggtcacaagaccggggttagaccagcccgtcgggagcgcggcgatcaatcatgtgccgcgggagatgattacccgcgaggtggaagaagtgtgtgcgcttaccgattatgcggggagccttttggtggagatttcggtgcaggggggagaggaacttgcccaaaagacgttcaacccgagactcggtattgtgggcggtatctcaatccttggaacgaccgggattgtggagcccatgagcagtcaggcgctccttgacacgatctatgtggagcttaagcagaagcgcgaagagggaaaccggtttgcggcaatctcaccgggaaattacggtctggaatatatgaagcgcgcttacgggttcgatctggaccgaagcgtcaagtgcagcaattttatcgggaagacgatggatatggcggtggagctcggatttgaggcggtgcttctgaccggacacatcggaaagctggtaaagctctccggcggaattatggacacacattccagggaggcggacgcgcgcatggagcttctgatggctgcggcataccgcgccgggtgtgcgcccgatacgctggggaagatcttagactgtcttgtgacggaggaggcgctcgcctacattgtcaaggacggatgtctttccgcgacgatggaacttttaatgaaaaagattcttttttatttaaagaagcgggtgaaagaggaactgcgtgtggaatgcattctctatgcgaacgggtacggcgagctggcgagaagcgacggtgcggtagaacttctggaacgaatccgcggggaagaagaacatttgcagtaacgcagtttaaggaggaaacgatatggtatattttgtcggggcgggtccgggagcaaaggatttaatcacggtccgcggaatgagactgctggagcaggcggatgtcattatctatgcgggatcgctcgtgaatccggagcttctttcttatgccggaagcggggcaaagatctatgacagcgcaaaaatgacgttggaggaagtgcttgcggtcatccgggaggcggaggaaaaagggcttaccaccgtgcggcttcacaccggggagccgagtctctacggggcggtgcgtgaacagatggatgtacttgcagcggaggggatttcctatgagagctgtcccggcgtcagcgcatgctttggcgcggcggcggatctgaatctggagtatacgctgccggggatctcgcagagcctgattatcacgcggatggcaggacgcacggcagtgccggagcgggagagcatcgagagttttgccgcacatcaggcgtccatggcagtctacttaagtgcgggaatggtaaaagaactgtcgaaaagactgatggacggagggtatgcgccggatacgccggcagcgatcgtctataaggcgacctggccggacgaggaggcgtacgtgtgcacggtggagacgcttgctgctgtggcggtggagcatcagattacgaagacggcgctgattctggtgggagatgtgctggcagcgccggggtatgagcgctcgaagctgtatgatcccgggtttaccacgggataccggaaggcaaaaaaggaacagggagagacaaagtgaagaagacggacatagctgtcatcagctttacttacaggggggcagaactggcagaacacattcaggaagcgatggatgccgtatggtcctgtaaattatatacaaaatgcagcgacgcccgggcagaggggatagggatttccgtggatcagccacttgccgaatggacaggaaaacagtttgcggcgggaaatgcgctcctgtttatcggggcatgcgggattgcggtcaggagtatcgcaccgcatgtaaaagataagctttccgatgttccggtgctcgtggcggatgaggcggggcagtttgtgatcccgcttcttgcaggtcattatgggggagccaaccggcttgccggggaactttcaagagccctcggtgcgactgccgtgctcaccacggcgacggatgtgaacgggctttttgcggtggatgtgtttgcagcgtcaaaccgtcttgccgttgccggtcatgacggaatcgcccgggtgtccgccgggcttctgcgcgccgggtatcttaccatgtccgtcgccggagaatgtgaaggagagattccgccggaggtaagactggtaccgtatccgccaaaggagccggtggatgtgctggtcgcgccgcagtgcgaagccggggaacgatgcagcttatggctgattccgtcctgcctgctgcttggcgtcgggtgcagaaggggcaaaagcgaagaggaactggaagcgtttgtgcgggagaccctggaaaaagagaagctttccagcatggcggtggcgggaatcgcgtcggtcgatgtaaaagcggatgaggtaggaattctggcactggcagagcagttagcggttccttttctcacttatccggccgggcgcctgcagtgtgtggacggtacattcacgtcatccggctttgtggcgcaacaggtcggcgtggataatgtgtgtgagcgcgcggcggtctgcgcggcgggggagggcggcagacttctggtgcaaaagacggcatgtgagggcaagacgcttgccatagcagagaaaaaatggagtgtgaagttttgatgaaacatgaaatctatattgtcggaatgggaccgggcagagaggaagatatgacacaggaagcgctcaccgtgctggattcctgtgacgtaattgtgggatatacggtgtatctgaatcttctcggggaacgatttttggggaaaacgtttttgtcgactccgatgcgccaggaagtggagcgatgcaggatgtgctatgaggaggccaagaagggaaagcgcgtagcgctgatctgtagcggggacgcaggaatctacgggatggcgtcactcatgtatgagatgagcgcagaatatccgtcctgtgaacttacggtggtaccggggattaccgcggcaagcagtggtgcggcagtgctcggcgcgccgttaaaccatgacttctgcgtgatcagcttaagcgatcttctgactccgtgggagcagattaaagcgcggcttcgggcagctgttctgggggatttcgcgatagcgctctacaatccgtcgagcaggaagcgcgcagattatctgcagcgcgcctgtgatattctgctggatgccggggcgaagggaacgcgtgcctgcggctatgtggaaaacatcggaagagacggggagacggcacacacctgcaccctgcaggaacttcgtgagattcaggtgaatatgtttaccacggtatttatcggcaactcacagtcggtcattatgggagataagcttgtcacaaagcgcggctatcagatcggggcaggcgccagggcgcgtgcgaaggagcgcggataagaggtctggaaatggagagaatatggcagaaatattgattttttccgggacaacggagggaagagaattggcggaggcactctgtgccagacagattgactgtatggcgagtgtggcgaccgagtacggcagggaagtgatgcgtcagcaggagcatcttgtgatccgggaagggcggatgggcgaaccggagatggaagaactcatgcgaaccggtacatttcttgcagtggtggacgccacgcatccctacgcggtggaggtgacggagcacatcaaagagagcgcaaaaaagaccaatcttccctatttaaggctcagccggagcacggcagcggagcgtgagatcgcagagcacgagtggatgatacatacggtggcggacacgcaggaatgtgtagaactgctgtctaagctgccggggaacattcttcttacgacgggcagcaaggaactgcacgcatatgccgcccgggaggagatccgtgagagactttttgtgcgtgtgcttccgggggtggagagcatcgaaatctgccacagggaacagattccggggaagcagatcattgccatgcagggaccttttggaacggagctcaacgaggcgctgatccggcagtatgacatcggcgtgctggtgaccaaggagagcggacaggcgggcggatttccggagaagatccgcgcggcagagcacacgaaaatcccggtggtcatgattcagaatccggagcaggcgggcgggatgagcatggaaaaagtcctgtccgaaattgaaacgctctgcgggaaaaagagcgggacgaagcgtcagccgctgcagatttctcttgtgggaatcgggatggggaacacaaagttgttcaccggagaggcaagggaggcgattgggcaggcgaaggcggtctgcggagcgaagcggctgcttgccgcggcggataccctgatcgcgccggatgcagagaaacgggaggcgtaccttcccgcagatcttcttccgtatatttattcctgcagggaaagaaaaatcgggcggattgccatcttattttccggtgataccggattttacagcggcgcagaggcggtgtataaggcattgcaggaagaagtgcgccttggaaaattacaggccgggatcaccatctgtcctggaatctcctcgctctcctatctggcggcgcgcgcaggtaaaagctggcaggacgcgaagatagtcagcacacacgggagagaggcggatgttacagcgtatgtgcgcagtgaggaaaatgtatttctgattgtttcaggcagaagcgatctaatccgcatcggggaagaacttgaggcggcgggactgtccggggtggagcttaccatcggataccagctctcctacagggaagagcggatctggcacggaacgccggaagtgtgccggacgttaaaggacgatggactctatgcctgcctgattgaaaatccgggggcacagggggagacgctcgctccgggagtccctgaccgctggttcgtgcgtggacgagtccccatgacgaaggaggagatccgctggctgtctctgtgcaggctcgggttaaagagtcagagcgtattttatgatattggaagcggaaccggctcgattgcggtggaggcggcgctgcggtcaaaacagctgcgggtgtatgccgtggaacatggagaggaagcctgtggactgattgcggaaaatgcatcgcgtgcaggcgtgaagaaccttgttgtcgtaaagggggaggcaccggaatgtcttggggaactcccggtgccgacgcacgcgttcatcggcggaagcggcggcaggctgcgggagattcttctggcactccgggagaaaaatccgaacgtgcgcgttgtcttaaatgccgtctcgcttgagacggtcgccgaggttgtggcactgtggaaggagcttttgatctgtgaggaagagatcacacagattgcggtcagccgcgcaaaaaaagcaggttcccatcatctgatgcaggcggagaatccgatctatgtgatctcgttttccctgtcggagaacggcgagggggaagaacaaaaaccggacagacgggaggagaggtaagatgaacattcccagaatcatgattgcggcggcgggaagcgggagcggcaagacgcttctttcctgtgcgctgatgatgcttttttcacaggaaggaaaaagcgtcagtgccatcaagtgcgggccggactatatcgatccgatgttccatcggacggtgctcggcgtcccttcccggaatctggacacttttttcactggggagagactgacgaaaagcctttttgcgcgcgcggcagagggcgcagaccttgcggtgatggagggcgtgatgggactttacgacggcctcggtggaatccgcaaggagggatcgtcctaccatctggcagaggtgacgaagacacctgtgattctggtggtgaacgcacatggaatggggcgttccattctgccggtcataaggggctttctggactatgaccggcatcatctgatccggggcgtgatcttaaatcagacatcggtgacattctgtgagacaatccgtcccgaaatagagcgcgagctgtcgctgccagtgctggggtgtctgccgaagttaaaggaactgcactgggacagcagacatttaggacttgtgatgcccgaagagattgcggatgtgaaaaagcagattcagacggtggcggatacgctcggaaaaacgcttgactgcgggaagcttcttgcgattgccgcatccgcagaagcgctggagacagatccggtgccgaaaaaaaagattgcggatgtaagaatcggaattgcaagagacgcggcgtttggtttttactatgaggacaatctgcagctactgcgggaggcgggagccgagctggtgccgttctctccgttacaggatgagagcctgccggaggggattgcaggactgatcttaggcggcggctacccggaactgcatgcaaaagcgctgtcgaaaaacatcccaatgcgaaaagcggtgcacgacgcggtggcggacggtctgccgacgatcgcggagtgtggcggattcctctatctgcatgagacgctctgtgacgatgagggagtgtgctatccgatggcgggagtgattccggcgtcggctataaataccgggaaactggtgcgcttcggctatgtgatgcttacggaaaaggaggagaacttcctcccggcgggcgcacagattgcggggcatgagtttcactattatgacagcacggacaacggcgtgggtgcggtggccaaaaagccggtaaacggaagatcgtgggagtgcgttcatgagagtccgtcgcaatggatgggattcccgcatctatattattactccaatccggaatacgcgtaccgtttcctgaaaaaggcggcggacagaatctacttgaaaaaataaacatgcaatggtaatatgtttttaatttcataaaaaagtaactggtgccggtgcaaaggtatgtgcagaagatgtacagatgagcctttgtaccggttaaaagggaaacaggtgggaatcctgtacgatctcgtcactgtgattagggagtgcagatacgaaagctttacgccactggcgcgcatgcgccgggaaggtaagtagctgcatgaggatctatcagccaggaaacctgccagttatgatagtacaggaagagattccggatcacgagtaattggtcgtacttttgtgtgttgatcagctgctccgtttctatgtttcatagagcggagtttctttctgttgttttatggaaaatatacaatcatcagcaggaggaattatgaaaaaaaagacactggcactcttactaagcctgacacttgcagctggcatgatcggtggatgcggcagtaagacagagacaaccacagaggagaacgtgcagacagcacagacagaggctgttgcggagaccgggacagagacagtatccgatcaggatgcggcagatcatgttgctgcgctgatcgatgcaatctacgtgcaggagcgcacggatgagaccgatgcgcagtgtgcagaggcaagggcggcatgggatgcattgactgacgcacagaaggaacttgtcgaaggtgagaacgcagatccggattatttcggaagagataccggagacgcttccaaggacgatccgttaaatgaggatgagatcggtgagaatgagatccttgtcgtaagtttcggaacatctttcaatgacagccgtactgaggatatcggaggcgtggaaaaagcaatcgcggaggcttatccggactggtcggtaagaagagcgtttaccgcacagattatcatcaatcatgtacaggcgagagacgatgagaagatcgacaatgtagaccaggcgttagaccgcgcggtggcaaatggggtgaagaatcttgtgattcagccgacacatctgatgcatggcgcagagtatgacgagctgatggaagcggtggagaagtaccgcgatcagtttacatccgttgcagttgcagaaccgctcctcggtgaggttggcacagatgcaaccgtgatcaatgacgataaggaagccgttgcaaaggcgatcacggcagaggcagttgcagaggcaggttatgactccctggatgcggcagcagaggatggtaccgcattcgtattcatgggacatggaaccgctcatactgcgaaggtaagctacagccagatggcaagtgtgatgaaggacttaaactacgcgaatgtcttcatcggcactgtggaaggagaaccggaagagactgcatgcgaggcagtgatcgaggcagtcaaagaagccggctacacgaaagtggtattaagaccgctcatggtagtggcaggagatcatgccaacaatgatatggccggggatgatgatgattcctggaagagcatgtttgaggcagacggagcgtttgagagcgtcacatgccagattgcaggtctgggaagaatcgatacgatcgagcagctgtatgtatcccatacacaggatgcgatcgattcgctcggcagcgtagatactgtagcagcagcaaccacagcaggagatctggaggacggcacgtacagtgccgtcttcgacactgacagcagtatgttccatgtcaatgaggcatgtgccggacgcggcacacttaccgtcaaggatggcaagatgaccattcacgtaagtcttgtgtcacagagtatcgtaaatctgtatccgggaaccgccgaggacgcgcagaagagcggagccaagctgcttgagccgacgaaggataccgtaacctacagtgacggaacatccgaggaagtgtacggattcgatattccggtggaagcactggatcaggaatttgatctggcaattattggaaccaagggtgtgtggtacgatcacaaggtgagtgtatccgacccggttgcggagtaagagatgaagaagaaagtaacagaactgatcgtatgcctgctgtctgtgatctgtttcctcacagcgtgccacacgccgcagagcgaaaaactggcggacggaacctatcaggcggacgttacgctcaccggcggcagcggcagggcgacggtggactcaccggcggcgattacggtgaaggacggcaaaatatatgccaccatcgtgtggagcagcccgtattatgattacatgatggtagaggatgagacctgctacaacgaggcagaggcaggagagaactcgacgtttacgattccgattgaaaagctgccatgtgagatctcggtgattgcggatacgacggcgatgagcgtgccgcatgagattgagtacacactgtcatttgcgttaaaagagacggacttttcggaactgacgaagacggggcagtgggatctctcttatgccacgcagtatcgtgtggaacaatacggggagtatgatctgattacaatggctgatgacagccgttttttgctggtgccggagaatgttccggtaccggaacatgtgccggaggatgtggttgtgttaaaacagccgctggatcacacgtatctggtatcctcatcggtgatggatatgatccgtgagatcggagcgctttctgacatccggcttacaggagtaaaggagtcggactggtatatagagaaagctgcggctgcgatggaagacggccgtatgctgtatgctggaaaatacaatgaaccggactatgaactgattttaaaggaagggtgcaactttgcactggagaacacaatgatcggacataatccggaggtaaaagaaaagctggagagccttggcataccggtcatggtggaacgttccagctatgaagaacatccgctcggaagactggagtggatccggttatatggtcttttgtatggaaaagaacaggaagccgatgcattttatgaagaacagctaaaaaaaatagaaccaatcatggaaaaggaagatacaggccgcacggtggcctttttttatatcacggcgaacggagcggtcaatgtccgcaagccgaatgactatattgcgcagatgatcggactcgccggcggcacctacgtcctaaacgaccgtctttcggcggaggagaatgccctgtccacgatgaacatgcagatggaggatttttatgcggcagcgaaggacgccgacatcctcatctacaacagtacgatcgagggggagctttacagtgtcgatgaacttctggcaaaaagcacgctgttttctgattttaaggcggtaaaagagggaaatgtatattgtaccggaagcaatttctttcaggaatccacgggaacctgtgatttcattgaggatctgcacaaggtgcttgtggatgagacagatgataattatcggtttttaaaacacgtgaggtaagaatgaaacgatatgtgatagcctttggcgcgatgatcctgctgcttggcgggttgtttttctttaatatcggttccggaagtgtcaagatgacgggaagtgagattgcggacattctgctgcaccgctttggaggcacggcggatgagacggcgcggcagattgtctgggagatccgcctgccccggatctgtgcggcagttattctggggggagcgctctctgttgcgggatttctgctgcagtcattttttcagaatccgattgcgggaccttatgtgcttggcatctcatccggggcgaagcttgtggttgcgctgacgatgattgcccttttggaaatgggcagggcgatcagttcgctcggcatgattgtggcggcgtttgccggatcgatgcttgcgatggggttcgtgctcttaatttcctgccgggtaaaaaaaatgtccatgcttgtggtatgcggcattatgatcggctatatctgttcggcaatcacggatttctgcgtgacgtttgcggatgactccaacattgtgaaccttcacaactggtcgatgggcagtctctccggaatgacctggtcgaatgtgcggatgatgacagcggtggtggcagtcacgatgggagtgaccttttttctggcaaaaccgatcggtgcgtatcagatgggcgaggcgtatgcgagaaacatgggcgttaagatccgtctgcttcgcgtattgctgattctgctgtcgagtctgctgtctgcctgcgtgacggcctttgccggaccgatctcctttgtgggaattgcggttccgcatctggtgaagacggcgatgaagacggcgaaaccgcttttgctgataccgggctgttttctgggcggggcaattatcacgctgttttgcgacggctttgcgaggacggtgtttgctccgacggagctttcgatcagttcggtgacagccgtatttctggtgccggtagtgattgtgatgatgctgcgcaggaatgaggacaggtaacggaggaacgtgtgatggaacagaggaaaaaagagtctggaatcaggcttgaggatgtggcggcagggtacggcagaaaagctctgcttaaccatatttcgctgcatgtaagtcccggaaacgtcctgacgctgatcggaccgaacggtgcaggcaaatccacgatattaaaaaccgtgaccagacagcttgcagagcttggaggaacgatctttctggaggggacagccatgagccggatgcgggaagaggaagtcgcgcggacgcttgcgatggtgatgacggaacggcttcatccggagtttatgacctgccgcgaggtggttgcgaccggcaggtatccgtataccggaaggctcgggattctctccgcagaagactggaagcttgtggatgatgccatgcagctggtgcatgccagggacaccgcggaccggaatttttcacagatcagcgacggacagagacagcgggtgatgttagcgcgcgccatctgccaggagccgcggattctgattctggacgaaccgacttcctacctggacatgcgctacaagatcgacattttatccagtatccgaagactcgcggcagaaagaaatatggcggttgtcatgtcgctccacgaactggatctggcgttaaaggtatcggatgtgatcgcctgtgtggagggagaccacatcggaaaaaccgggacgcctgaggaagtattttcgggcgattatattcaaaaattatacggggtggatgcagagtgttttgatccgcggacaggcgccgtgtatctgcgtggaaataaaagccgaccaaagatctttgtgatcggtggggctggcagcggcataccggtctatcatgccttacagcggaaaaatgtgccgtttgcggcgggaattctgatggaaaatgatgtggaatatcaggattcgtgtgccgcggcaagccgggtggtttctgtgaagccgtttttcccggtcacagaggaggagatcgcggaggcgagatcgtggattgagacgtgcgagacgtgtgtctgttgtgcggaaacctttggaccttacaacgaagcgaaccgcgcgctgcgcgagtatgcaaaaacactcggaaagctgattcctgcagaggtgctgcatcatttggaaggaacttgaaatggcggttgactgcaggagacggcgtgtgaatttggagacagcaggtgtgccggaacggtgaatgcatcggggagggcatgtgcaccggcggcagagaaagagaggtgcgcgatggagcgtggcatattggtcgtgagctttggaacgacttatcaggagacaagagaaaagaatatcgatcagatggtggcgcttgtcagagagcagtatccgcatgatctggtggaggaggcgtattccagcagcactgtgaggaaggtgttaagagagcgggacggcatcgcgaaagatgatgtgaggcaggcgctttgccggatgcgcgatgccggggtgcggcgtgtgatcgtatttccgacccacatcattgacgggattgagaaccaccggatgaagcaggaggtaacagattgtgcaccgtggtttgaggatgttcggattgcggatgcgctgcttaagacaccggaggattatcagagaacggcggaggctctctgggaatcggtggcggcggaggcgggatcttcgccggtgatttttatgggtcatggaagtgagcatgcggcggatgagagctacgagcgtctggaatgtgtgcttgcacaggtgacagagaacgacgtctatgtggcgaccgtggagggaagcgttacgattgacgatgtgatcgggaggatgagggcctcaaggcataagagcggacgtgtgcttgtggcgccgtttatgctggttgcgggagatcatgccaatcatgatatggcaggagaggaggattcctttgctgccgcactccgcgaggcgggatatgaaccggtttgcctgttaaaggggattggagagtatgagccggtgagagagtgctatttcagacatctgcggcactgcatgggaaccctctacgggatcggcgtgggtcccggcgatccggagctggtgaccgtaaaggcgctccgctgtatggagaagagtgatcttatcgtgcttccggcggaggatcctgtgggatgccatgcgtatcagatcgcaaggcaggcataccccgggattgagaaaaaggaacttgtctgcctgccgtttccgatgacaaaggagaaagaaaagctgcgcagggcacacgaggagatttttgcgcggattgtttcttatcttaccgaaggaaagattgtggcatttttaacgatcggagatccgtccgtctattccacatacggttatatccaccgcagggtcgcggcgtggggcgggaatgttaaaatgataagcggcgtgccgtccttttgcgcggctgcggcgagtcttggaatatcgctcggggataaccgggatgagatccatgtgattccgggatcgtacgaggtggaggagacgatggcgctttccggcacccgggtgtacatgaaatccggaaaaagcctcgcgcggctgaaagcgctgttggaagaacagcagaaggagaagaaactgtccgtctactgcgtggagaactgtgggatggcggatgagcggatccgcctgggagcggaggcgctcgaggagaacggaagctatcttacgacgcttattgtcaaagatgagggagaggtggtataatgacagagaattcatatcgctttttttccaaccgggaatgtcagtattatccgtgccatgagggcattgaggagatgaactgcctgttctgctattgtccgctctatgagagacgtcattgtccgggaaagccagagtatattaagagcagacgggaggatggaagcgaagtacagatcaagtcctgcatgaagtgcacgtttccacatcaggcggagaactatgatgtgatcatgcagtttttgaggaagggagatagataggatgaagagagtatttttgattgtattggacagcgtggggattggcgagatgccggatgctgcagattacggggatgcgggaagcaacaccatcaaagccgcttccatgagcccttatttttccatgccgaacatgagaaagcttggcttttttaatatcgacggcgtggagatcggggaaaaggaggcagctcctgccggagcggttgcccgcatgacggaagtgtcaaagggaaaagatacgacgatcggccactgggagattgcaggcgtcatctcaccaaagccgctgccgacctacccgaacggtttcccgcaggagattattgaggaattttccaaaaagacaggaaggggcgtgctctgcaacaagccgtattccggtacggatgttatccgcgactatggggaggagcatcttaagaccggcgatctgatcgtgtatacatcagcggattctgtgtttcaggtggctgcacatgaggatattgttccggtggagaagctgtatgaatactgccagatcgcgcgagatatgctgcgcggagagcacggcgtcggccgtgtgatcgcgagaccgttcaccggaacgccggggaactttacccgcacgacccgcagacatgatttttccttacagccgccgaaagtgacgatgttagaccagctctcgggagccggttttgacgtgctttctgtcggtaagatcatcgatattttcgcggagaagggcatcacggagtatgtccgcacgaccggaaatgaggacggcatcaacaagacgcttgattatatgaagaaggattttaacggactgtgctttacgaatctggtggattacgacatgctctacggacaccgcaatgatgtcgagggctacgcaaaagcactgacgtacttcgatgagcgcctgccggaacttttagcagcgatgggcgaggaggacgtgctgatgatcacggcagatcacggctgcgatccgagtacaccgtccacggatcattccagagagtacacgccgcttgtgatgtacggagcaccggtgcgggcaggggagaatttcggaacaagaaagagcttttccgacattgcagcgacgattctgtcctactttgatctgaccccggagtgcgcgggcgaggcaattccagtattcaagaaatagtacagatctttggaagagaagtttttgcatttttcatgaaattatgttatagtgccaacgtatgcaaagtttcggctttgctgcgttggcatttttgaagtgatttgttttttggaggatagatagtttggctgatttaagaaaagagattgaaaagagacgtacgtttgcaattatttcccacccggatgccggtaagacgacgctgacggagaagttcctgctctatggaggagcaatcaatctggcgggttccgtcaagggaaaagcgacggcgcgtcatgcagtgtccgactggatggagattgagaaggagagaggtatttccgtcacgtcatcggtactgcagttcaattacggaggttactgcatcaacatccttgatacaccgggacatcaggacttctcggaggatacttaccgtaccttgatggcggcggattctgccgtcatggtaatcgacggttccaagggtgtcgaggcgcagaccagaaagctgttcaaggtctgtgtgatgcgccatattccgatttttacattcatcaacaagatggaccgcgatgcgaacgacacgtttgatcttcttgatgagatcgagaaggagcttggcattgcgacctgcccgatcaactggccgatcggttccggtaagaattttaagggggtctatgaccgcaacacaagagagattatgatgttttccgatacattaaagggaaccaaggaaggtacggagaagcatatttccgtggacgatccggcgctgattgcagagattggacaggatgcgtatgataagctgatggaggagatcgagcttctggacggagcgagcgcggagtttgatcaggaactcgtgacgaagggagaactttccccggtattttttggttcggcattgacgaatttcggtgtggagacctttttgcagcatttcttaaagatgacttactcgccgctgccgcgcaaggcggatatcggagaagttgatccgtttggtgagaatttctctgcgtttgtattcaagattcaggcaaacatgaacaaggcacaccgtgaccgaattgcgtttatgcgcatctgctcgggcaagtttaccgccggcatggaagtgacacacgtgcagggcggcaataaaaagatcaagctttcgcagccgcagcagatgatggcgcaggagcgtcatatcgtggacgaggcgtatgcgggagacatcatcggtgtgtttgatccgggtattttttccatcggagatacactcaccacggcgaagccgtttaagttcgagggaatcccgacgttcgcaccggagcattttgcgagagtgcggcaggtggatacgatgaagcgcaagcagttcatgaagggcatgcagcagattgcgcaggaaggtgcgatccagattttccaggagtacaatatgggaatggaggaggtcatcgtcggcgtggtcggtgtactgcagttcgatgtgttgaaataccgcctcgagaatgagtacaatgtggaaatccgcatggatacgcttccgtatgagcatatccggtggattgagaatgaggacatcgatatggataagctggtcggaacctcggatatgaagaagattcaggatctgaagggcagaccgctgttactgtttgtcaatgcatggagtgtcggcatggtattagaccggaacgaaggtctggtactctcggagttcggcagggaatagagcgtgtgtcagagcagctgccggcagaaaacagtgccggcggaatgcacagaaaggaagcagaatatggcagttgttacaattacaaatgaaaattttgaggacgaggtgctggcggcaaaggtgccggtcattctggatttctgggcagagtggtgcggaccgtgtaaaatgcagtcgccggtatttgaggcgctgtccgaggagcttgccggaaaggtgaagttcggaagcgtcaatgtggacgagcaggcggcgcttgcgttaaagtatcaggtgatgagcattccgatgctcgttgtgatgcagtacggcatttttaagaaaaaagcgatcggactgcagacgagagaggaaatcttagatctgcttgcatgctgcgaagcagaatagataacaaagcgttagagaagggaattgccgcaataagcatagagcttttgggcgataagtaatattatcagaagatcacaccgtgggatttcagatgaaaatgcagatggaaattcggttcaaaaaatgtggaatttctaaccagccgaatgtttgcatcttcgatgatccgtgtctttccaagtttggagcactccgcgggtcatgtccgcatcccggaagacaatttgtaggacttttgtgtgtgtcccttattggcaccagacaacaggtggcataaatgccacctttatgtcgaataaaacataaccgcgcgaaaccgatgtctgagttgccatctgccctattttcaatagcagatggcaacgagtttcggttcgcgcggttttatatcgtctgtgaagaggtgccattagggacaccagaaagtccgcccattgtctccggtgtgtcggacatgcccccgtcggattgtccaaacgtggaagagacacggaatccgatgcaaacattcagccggaagaaatgctcacatttttctcaaacgaatattccatttgcatttccacatgaaatccccaagtgcgtttcttataatattacttatcgatgcaaagcgagctatgcttattgcgacagtccctttaacggttttttacggtgtaagcggctttttctgagtgcatttccatgagaagacgtggaatcgtccatccggcgtttgtgggcgtgagtacagccttgtagtcgatgggggcgtcgatgcggcgcagttcaaacagcagcttgtccatccggcgctcgggcagctggcacatgacgagcagacggtcgcgggagacggctgccggagtgctgccggcttcgggtatgccgcaggcagcggaaacggcggaggcaccggcaggggcatctgcgcctaaagcagccgtgaggctggcggggacaggtgtgccgggagcggcggggatgccggcaggaaccgcccggccggatgcgattgcgccgagcgtattgtggtacatcgaaacgggaatctgctcgcagtgcagtttcagccgggatgcaaccggttttatcttttgaaattcagcgtcggtaagtccgaagaacaacagtttttccatagatacctccagaaatcagatcgtagttttgtcagaggtcattataacacagatttgcaggaatacaacgaaaagcaatgtgagaaaatgtccggttttccggtaatttgtgattgcggatatggggcggatatggtagtataaggcatacccgttttttggaggggcgtctttttatcaaatcatgcaggcagggaagtcctgctgtgcaatcagggctgctggagcggtcatcaggcggtatccgccacggaattcattgaggtgttacttatttttcgggtttgtggttgacattttcccggaagtatactactattagaacagaaaaacgaacataagttcgcaattcgtgcgcggacggttcgcatggaggaaagagaatggctaaggacgataaactgacaagggatgagagacctacgacaaaggaagagaagttaaaagcgcttgacgcggcgatttcacatattgagaagcagtacggcaagggatcggtcatgaagctgggcgataattctgcacacatgaatgtggaggcggttccgaccggatcattgagtcttgatctggcgcttggaatcggtggtctgccgaagggacgtatcatagagatctacggaccggaatccagtggtaagacgacggttgcactgcatgcggtggcagaggtacagaagagaggcggcatcgccggatttattgatgcggagcatgcgcttgatccggtctatgcgaagaatatcggtgtcgacatcgacaacctctacatatcacagccggactgcggggagcaggcgcttgagatcgcagagacgatggtgcgttccggagcagtcgatattgtgattgtggactctgtggctgcgctggtaccgaaggcggagatcgacggcgatatgggagattcccatgtgggactgcaggcgcgcctgatgagccaggcgctccgtaagctgacatcgattgtcagcaagtcgaactgtatcgtcatttttatcaaccagctgcgtgagaagatcggcgttatgttcggtaatccggagacgacgaccggcggtcgtgcactgaagttctattcttcggtgcgtctggatgtgcggagagtggaggcgttaaagcagggcggtgaggttgtcggcaaccatacgcgtgtgaagattgtgaagaacaaggtggcaccgcctttcaaggaggcggagttcgatattatgttcggacagggtatttccaaggaaggagatattctcgatctggcggcggatgccggcatcatcaacaaatccggtgcatggtatgcctacaacggcgagaagatcggccagggacgtgagaatgccaagaactacctgaaggagaatccgctgatctgtgaggaagtggaagcgaaggtacgtgcaaagtacagccctgaggaagatgaggctgcagaacagccggatgagaagagtgcgggaaagacaacaggacgtactccggaagaactgccggcagaataaggataggagtgcaacagacagatcatgcaggaagtccaggtaaaggaagtagccagacgtgagaagggacgggtgtttttccggtttgacaacggaaccgaatttacactctaccggagcgagatccggggactgccgcaggcggagagcatgcttttgatgacggaggatgcgtatctgccggtatcactatatgagaagattctgacggagattgtcggaaagagagccaaaaagcgtgcactgtttctgctggagcgcatggaccgcacggagtcgcagctctgtgaaaagctccgccagaacggttatcccgaggagtgtgttgcggcggcggtggagtatgtaaagcagtatcactatatcgatgacctgcgttatgcgaagcagtatatccgctatcaccagcagaagaagagcagccagcgcttaaagatggacctcatgaaaaagggggtagggcgggagcagattgagcaggcactcgcggaggagtttgtgtcggatgagcgggcacagattgcggagcttttagagaagcggcactacgatgcggcgcaggcagaccgcagggaacagcagcggatgtatcagttcctcatgaggcgcggttttaagagcagtgatattcttgcagtgatgcgcgaagagcattttttcgacgaattttaaaataaatttcagtacaatatcttgtatttttgtaaaaatgaaatgcaatattatgcatattgtacagttattcacttgacataattcatgaaatagaataaaatttatgtgttgtaatttatgacagataacgattatatttttatgttatatgtgttatatgtacaatgaaaacttaataaaggaggtgctcctgtggagacagtgattgctgttgttgttgctatcgcagtgactgccatcgtggtctattttgttacatctgcttaccataagaaggtgacggaagccaagattggaaacgcagaagagaaggcaagagagattattgatgaggcggtgaagacagcggagaccaagaagcgcgaggcaatgcttgaggcgaaggaagaatccattcgtgtgaagaacgatctggataaggaagtaaaagaacgccgggcagagattcagcgcagcgagcgtcgtgttgtacagaaggaagagaatctggacaagaagcttgagtcaatcgagagacgcgaagcgggttttgctgcaaaggaagaagagatcaacaaacagaaagcgcaggtcgcaaagctcaatgaagagcggttacaggaactggaaagaatctccggattaacctccgaacaggcaaaggaatatctcttaaaaaccgttgaagaagatgtaaaacttgatactgcaaaattgatcaaagaaatggaacacagagccaaggaagaggcggacaagaaggcaaaggaatatgtggtaacagcgattcagaaatgtgcggctgaccacgtcgctgagacaaccatttcggttgtccagcttccgaatgacgagatgaagggtagaattatcggacgtgagggacgtaatatccgcacgctcgagacactcaccggtgtggatctgattatcgatgatacaccggaggcagtaatcttatctggatttgatccgatcagaagggaagttgcccgcattgctttggagaagctgattgtggacggacgtattcatccggccagaattgaggagatggtcgaaaaggcacagaaggaagtcgagacaatgatccgtgaagaaggtgaggctgcaaccttagaggttggagttcacggaattcatccggaacttgtccgattgctcggcagaatgaagttccggacgagttatggacagaatgcattgaagcattccatcgaagtagcccagttatccggattgctggctgctgagatcggtgtggatgtcagaactgcaaaacgtgcaggtttactgcatgatatcggaaaatcagtagatcatgatatggaaggttcccatattcagattggtgtggatttgtgtagaaagtacaaggaatcaccgattatcatcaatgctgtggaagcacatcatggtgacgtggagccggagtctctgattgcatgtattgtacaggcggctgatacgatcagtgcggcaagacctggagcgagaagagagacattagagacctactcaaacagattaaaacagttagaggatatttcaaacggatttaagggcgtagagaagtcatttgctattcaggcaggcagggagattcgagttatggttgttccagaacaggtcagcgatgcagatatggtattgatggcacgtgatatttccaagaagattgaagcggaaatggaatacccaggacagattaaagtaaatgtaattcgtgaatcgagagtaaccgactacgcgaaataacaaagagagcagagaaaagttgtcgcataaccgagaaatcgtgaagcggcagcttttttcatttcataggaaataccgtgccgccttcatgtgtgaatgcagaaccttcctatgaaataaaaaacgctccgcgaggatgcgcagctcgcggtaaggaaaatatcgctttgcaaaccgctcgcgcgcggagaatctcgcaagcgagattctttttcataggaaataccgtgtgatgttaaagcgtggaagatgtttcctgtagggcaaaatgcttcgcggaggccgcattgcggcgaaggcggggatgttatatcagatgcagaatagaaaggatgggtaatatggatcagcaggtaaagagagtcaagagagaactaataaaacatggtgcaattctggatatgtatgaggataccatggaacttccggatggaaagcaggagacatgggactttatctcacaccgcaagggagcggcggccgttgtgccggtgcgcggggatggaaagatcctgatggtaaagcagtaccggaatgcgatcgaccgcatgactctggagattccggcaggttcgcgcgacagcgtgacggaggataccagggtatgtgcagcaagggaactggaggaggagaccggctattgcagcgacgatctgaccagaatcttatctcttaagacgacagtcgcattctgtgacgagtttattgatgtctatctggcaaaaaatttaaagcccggacatcagcatctcgatgagggggaatttattgatgttgccgcctacggggtggatgaattgtgcgatatgatctatgcgggaaccatccaggatgccaaaacggttgccggaattttagcatataagaatctgctgaatcaggactaggagatccgcataaatataatacagaaaagatatgagcggagtgcaatgtttgaagcgggaaggatgtattgtgatgctggcatttctgggcggaattgttctgaccaatctgcttggcgcaaatcggcagatacatggacaactgctgaatcagacatttctgcaacagtatgcttatcaaaaagtggatgggaatcagctgtttggtcatgtggttatggtgcgcatgcagatgctggttctcatctttttgcttggaagagcggttgacggaaaggtgttttccgtgctggcaaagagcatgctctcagcaggattcggattcttgcttgttgtcggaattatggaatacggaggatatggctgcctgatcattcttgccggattgctgccgcagtggattttttatacggcggcgctgcttttctatgcgaacagtaagaaaagacagagcagaatcgtgggatggaacagctggcaggatcggacgcggcagctggcggaagcggggcttgtgacaggctgtgtgttattgggaacgtttgtggagagctttgtcaatccggcagtattcgcctgggttttaaaaattttttgctaaaatttttaaaatgattacaatatatggtacggagaaaataagggaaacgagatgttgtagtttcgctctaaatgcccgaattataagggaaaaatgcgattgcttttcggtttggttctgattataatgaatgatgtaccgcgtttgcggtacatttttcgacagagaagaaagccgcatacagcggagcaatgcagtgaacaaatgagtggcggggcaggtaaacgttatgacgcaggacatacagaatttcattcaatatttacatcaggagaagaatacctcagagaacacggaggtttcttatgcgcgtgatttgaagaaaatgaatcagtatcttctggcacagggaatctgcgatgtgaatgaggtgacggctacaagtctgacatcctacgtcatctatctggaaaaggaaggaagaaagcctgcgacgatctcgcgaagcattgcgtccatgaaggcgttctatcattatatggagaaggagcggagactggcagtagatccgtccgagcgtttaaaggcgccgcggattgagaagaaaatgccgacagtattgacgacggaagaggtgacgcgccttttggaacagccgggaggtacatcgccgaaggaactgcgggataaagccatgctggagttattgtatgcgacaggcatccgtgtgtccgagctgatttcactgagggtgtcggatgtgaatctgcggatggagtatctgacctgctcggatggacataaggaacggatcattccgtttggaatgattgcgcgcaaggcgctggaagcttatcttgcagagggcaggccgaagcttatatcagatgagaaggaagaccgcctgtttacgaactgttccgggcagccgatgagccgccagggattctggaagctgatgaagggctacggcaaaaaggcgggaatagaagcggagattacgccgcatatgttgagacattcctttgcggcgcatatggtcggcaacggggcggacttaaaatcggtgcaggagatgctgggacattcggatatttccacaacgcagatatatgcgcaggcgaaagatctgcagatgcgggaggtttatctgaaggcgcatccgcgcggataagaagacgggatataaaagagaatatataatagaaaaagaatataaaaaagaagatagaaaagaacataaaaagaggtgcagccacatggtttgtgtggttgcacctcttttgtttcataggaaataccgtgatacattcatgtgtgaaagtagaaccttcctatgaaataaaaaacgctccgcgaggatgcgcagctcgcggtaaggaacatatcgctttgcgaaccgctcgcgcgcggagaatcccgcaagcgagattctttttcagaacgtgcgttagcggcacatatctgcaatggtatagatcagatctctggaatcctcccagccaaggcacgggtcggtgatggatttgccatagatgtgatcgccgattttctggttgccttcctcgatatagctctcgatcataacaccttttaccatgtgttcgatatcggaggaaacctgtctgttgtgcatgacttcctttacgatgcggatctgctccttgaatttcttgccggaattggagtggttgacatcgaccacagcagccggattgacgagatccatttcctggtacatctcgcagaggcggatcagatcttcgtagtggtaattctgtgtggtgttgccgtgcttgctgaccgcgccgcgaagcacaacgtgtgtgagcgggttgccggttgtctcgacttcatagccgcggtatacgaagtggtgtgggtgctgtgcggcgtagacggaattgagcatgacggaaaagtcgccgctggtcgggttcttcatgccggaagccacatcaaaaccgctcacggtgagacggtgctgctgatcctcgacggaacgcgcgccgatggcgacataggacaacaggtcttccacatagccccagttctccgggtagagcatctcgtcggcgcaggtaagaccgctttcctcgatcgcgcgaatgtgcattttgcgcatggcgatcagtccctcaatcatgtccggcgctttttccggatccggctgtgaggcaatacccttataaccttcgcctgtggtgcgtggtttgttggtgtagacacgcggaatcagaatcagcttgtccgcaacatcctcctgaatggaagtgaggcggctgacataatcacagacggaatcttcgttgtccgcggagcaaggtccgatgatgacgagaaaacgggaatctgctccggtaatgacggcgctgatcgcagcatcacgctctttttttaacgctttcagcttgtcggaaagcggatagttctgtttgatttcggccggtgacggcagttcgtttaaaaatgtaaaactcatatgacattgtgtggataaggaaaaagacaccgcacactcctttctgtttgaatcgtaattatcttagctgatattacaatagatgtcaaatatttgcatatttattcagaatggagtaaactgtaaaaaaagccgtacatggaagtggtccggatgaaaaaatgcaggtatggaaagggagcaggaacatgaagccattggagataaaacaccgtgtgattgggagaggggaaccgttgatctgcgttcccgtggtagagcaggatgcacagtcggtgatccgggagatcacgtatctgagtcagagcaccgcggatatgatcgagtggagagtggatgcattccgcgattttacagattacaattcaatccggagcgtatttgaggctgtggcgcctctgctgggggagaagcttttcctgtatacattccgtaccgcgcatcagggaggcatggcgcaggtgaaagcggaacagctcgacgatctgcacgatcttgcggcggaatccggctgtgtcgatctggtggatctggaattctttgaggaagaccgaccgctccataagataaaaaggctgcgggagatgggagtgtcggtcattgcctcacatcacgattttgagcagacgccgtctccggaagtcatgaagatgctgctggagaaaatgtgcgccggcggagcggatattgtaaagcttgcggtgatgccgcagaattataaagacgtgctcaatctgctggatgtgacggcacagtttagagaggagaatccggatacgccggtgattacgatgtccatgggatcactcggcggcatcagcaggatcagtggggagacgttcggctcctgcgtcacattcggcgcgcacgaaaagccgagtgcgccgggacagttcgccatgaaagaactcagacagatgctggatacgattcatgccagcagccagatacaatagaattattaaaaaaagataaacacagggagattgcttgacgcagcaatctccctgtgctattataatgtcccaaattatgtaacagtgttaataattaacaaggtggtgaaatatggaagaattgtatgcgggtttatttcgggcgatgaaccgtttcggaaaactgcggatcggagaactgttttccgatatgacaaaaagcgacggcatgatgctctgggcaatttcacagttgaaccaggaaaagaataatgggagagctacagtgtctgaactggcagagaagcttcatacccagaattctgctgtgtcaaggactttgaagaatctggaggatcacggctggatctgcagaatgacagatccgaaagaccggcgcaatacctgtgtcgctctgacggagagtggggaggacatgcagcaaaatatgacatgcaccatgcaggaatttggcagggcagtcatttcgcagatggatgaacaggatctcaaaaagctcatagtatgcctggatgaattatatgacattgcagcagaagaaatcgagaagagaagtatgcgaaacagaaaggaaggacaacatgggaaagatttttaaaaatatgattccatactggaaaccgctgatcctggtgttattgctgttgtttgtgcaggcgtggtgcgatctgtcactgccggcatacacatcggacattattgatgtcggaattcagaatcagggaataaaacacatcctgccggaggcattgacaccggaggagtatgagaaggcagaacttttgatgacggatgaagagacggcatcctgggaggaaagctatgcgttaaatggcagtgtgtacgagcggaatgtgaccggggaagaacggctggaggaactggatgatacgtttctcgtaccgcttcttatgaattatcagatgtctgctatggaggaaagtacatttaagaaactgatggcagagcagatgcatacagatgagtctgcgctggacggaatgacgatcgagcagatcggcgcgtccatgggcgtggaattaaaaacatttgaaaaagagacgcagaacgaggacggaaatacgacgacagtcacctgtgtggatatgagagatctgctgcaggcgatggtatccggcggcatgctggaaaaagaccagcttttatcaatgcgcggggaactcaactcgatgctcgatgccatgggcagttcgcttgtcaaatcgatgggcgtggcgtacgcggcaggctgcgatgcggcggcaggcgtggatgtggaagcaattcagaagtcttatctgtggaaagccggtttgaaaatggtgggaatggctctgattatggggattgccacggtcttagtcggctttatcggcgcccgcatcggtgcaggaatcggacgtgatctccgcggaaaaatatttaaaagggtggtaagcttttccaatgccgagatggatcgtttttcaacagcttcgttaattacccggagtacgaacgatatccagcagattcagatgacatgcgcgattctgatccgtatggtagcttatgcaccgatccttggaatcggcggaatcttaaaggtactgcagaccggtgccggtatgggctggatcattgtgcttgcagtgcttgtaattctgggatatgtgatggttctgatggcggttgcgatgccgcgttttaagctgatgcagaaactggtggaccgcatcaacctcgtggcgcgtgaaatcctgacaggactttcggtcatccgggcgttcggcagggagaaaaaagaggagcagcgttttgacgatgcgaaccgcgatctgacgaaaaccatgctttttacaaaccgcgtcatgacatttatgatgccgggaatgatgatgatcatgaatgtgcttacggttggaattgtgtggttcggcgcacataagatcgatcagggaactatgcaggtcggctccatgacggcgtttatcacgtatgcgatgatgattgtcatggcattcttaatgctcgcggcaatgtcgattatgcttccgcgtgcggcagtggctgcggagcgtattgatgaggtcatccgcacgcagtcttcgatcgcggaaccaatgcagccggagaaaattaaagaacaccgcggcgtgatctgtttttcccatgtgaacttccgctacccgaacgcgcaggaggatgtgctctcggacattgactttgttgcggagccgggaaagacgacggcaatcatcggcagtaccggctgcggaaagtcaacactggtgaacctgattccgcgtctttatgatgtgacgggcggaagcattaccatggacggcattgatatccggaagcttgccatggcagaacttcgggaggagattggttttgtaccacagaaaggagtactgttttccggtaccatcgcatcgaatttaagattcggcaaggatgatgccaccgatgaacagatccgggaggcggcagagattgcgcaggcatcggattttatcgcggagaaaaaagaaggatatgacagtgccattgcacagggtggaagcaatgtgtcgggaggccagaaacagcgccttgccatcgccagagcgatcgcaaagcagccgcaggtttttatttttgacgacagcttttccgcactggatctgaagacggatgccgcactgcgccgggcacttgccaaaaaggttgtcgacaagacggtgatcatcgtcgcgcagcggatcagcacgatcctgcatgcagatcagattctggtattaaacgatggacgcattgtcggaaagggaacacacgaggaactgcttcgcggctgtgaaacttatcgtgagatcgcgagatcccagatgtcggcaaaagagcttggaatggaggaacaggaggtgtctgtgaatgagtaacggaaatgagacggcaaaaggaatgggcagacgccgtggaccgatgggcggacgcggtatgacgccgggagagaagccgaaggatttaaagggagccatcggaaaactggcatcctatatccggcattttaagtttgcaatcgttattgttgcagtatttgcggcgtgctccacggtgttcagcgtaatcggaccaaagattctgggaaaagcgacgacagcgctctcggaaggactgatggcgaagatccgcggaacaggcggaatagattttacttatataggaaagatcctgctgtttgtattggggctgtatcttctcagtgcactgttttcgtttgtgcagggctggattatgaccggggtgacccagaagatctgttaccagctccggaaggaaatctcggagaagatcaaccgaatgccgatgaagtattttgagagccgtacctacggtgaggtgctttccagaatcaccaacgatgtggataccttaggacagggactcaaccagagcattaccacgatcattacctcggttgcgacactgatcggtgtatttatcatgatgctcagcatctcgccgctcatgacgctgatcgcgcttgtgatcctgccggtctccgcggggctgatttccttcgttgtgaagaagtcgcagaaatactttaagaatcagcaggaatatctgggacatatcaacggacaggtggaggagatttacggaggacatctggtcattaaggcatttaacagagagcaggatacgatcgaggagtttgatgcgacgaaccagaagctgtatgaatcggcatggaagtcacagtttctctccggtatgatgcagccgatcatgatgtttgtcggaaatctcggatatgcagccgttgcgcttagcggaggtctgcttgctatccggggaacgatcacaatcggagatattcaggcgtttatccagtacgtgaaaagtttcacacagccgatccagcagatcgcacaggtcatcaaccaggtgcagtcgatggcggcggcttcggagcgtgtgtttgaattcctgaatgaggaggaagaagaccagtccgtggagaatccttgtgatatttccaaggtgacaggcgcggtatcgtttgagcatgttcatttcggctaccagccggatcagacgatcattcacgacttcagcgtaaatgtggctccgggacaaaagattgccattgtcggaccgacaggcgccggaaagaccactatggtcaaacttctgatgcgtttttatgatgtaaacagcggcgcaatctgccttgacggtcatgacgtgagaagctttaaccggcgggatctgcgtgaggcattcggtatggtgcttcaggatacctggctgtttcagggaacgatcatggaaaatatccgttacggcaggctggatgcgacggatgaggaagtcattgccgcagcgaaggcggcgcacgccgaccactttatccgcacactgccgggtggctatcagatggagttaaacgaggatgcaagcaacgtctcacaggggcagaagcagcttctcaccatcgccagagcaattcttgcagacaacaagatcctgattcttgacgaggcgacgtcgtcggttgacacacgcacggaggtggcaatccagaaagcgatggatcacctgatgaaggggcgtaccagctttgtcatcgcacaccgcctgtcgaccatacgcgatgcggatatgatcctcgtcatgaaggacggcgacatcgtagagcagggcagacacgaagaactgctcaaaaagcagggcttttatgcgaacctgtataactcgcagttcgaggagaccgtggcataagagacggcatgctccgaaagcggactgccgtacggcaaggagggataaggaatattacaggaacacccgggaacagaaagctccggaatagaacggacggcggcaattctgaccgcaaaatccggtatttttaaccacgccgcgcctggcatcttcgatgatctgtgtctttccaagtttggaacactccacggaatgagttcgcaagccggcagacaattttaggacttttgtgtgtgtcccttatgacacctctgaatagaacataaccgcgcgaagccgatgtttgagtcggcatctgccttattttcaatagcagatgccggcgagtttcggttcgcgcggttttatattgtctgtgaagaggtgccattagggacaccagaaagtccgctcattgtctgcagcttgtcggacacactccgtgagtgtccaaacgtggccaagacacgaaatgggatgccggacgtggcatggaagaaatacacgaattttgcttcaaagaatttgctgccgtccgttctatccggaactttcaggtatctgtttttcggaatattcctcatcccccatccttttccgttacggctggcgattacggggacgtgccggatcggacgccgcgtctgccggatgcgctgcattgcgcttggcgcgctgcatgccgccggtcatgtgggagagcgcgggcgctgcatcgtccgcttcgataaagcaggcgcgcttgatggaatcttccccgtagcgggagcggatggcgtcgaccgccacattcaggcgggagagcttctcgttcttctgcatgtcaaacaggtcgtactgctcgtagtgttcctgcgtcgccttgccggtcgagacgccgagcagccggattggacggtgatcccagagctcgtcgaagagctcacaggcacaggtgtacagcttctccgtgacgttggtggaggaagcaagcgttacctgtctggaagtgtggcggaaatcattgtccacaatctgcacctgcaccacgctgacataggcgccggcagcgcggattctggcaccgaccgtctcacagagcgagagaagcacatgctttgccaccgcggtatccgtcacatcgtactggagcgtgagggaattgccgaatcccttgcttgcggcgtcgttgtgggacagcggtgtggattcgattccgttggcataattccagatggtgtcgccgtgggatttaaagacggagagaatcatggcgtgatcgcttttggccagctggccgatggttgtgatgccgagggagcggagccttagggcggtggatttcccgacgaaaaacagatcctcgatcggaagcggccagaacttttcttccatttcggatgggaaaagcgtgtgtactttgtccggtttttcaaagtcggaggcagtcttggcgagcagccggttggaggagatgccgatgttcacggtaaagccgagccgggtgtgaatctcgtccttcagcctgtgggcaaagtccaccggattgccgtagagcgaggaggtgcctgtcatgtcgcagaaggcctcgtcgatgctgtaggcgtccaccgagggcgcatattctttgagaagtgccatgaactggcgggaacgctccacatagatgctgtagtgcggggcatagatttttaaatcagggcacttgcgccttgcctgggcgagcggctcgccggtacagacgccgagcgcggctgcggagggcgacttggcgagaacaatcccgtgccgtgtcttttcgctgccgccgatgacggaaggaaaagagcggatgtccggggcgtccggatcctggcgcagaagttcggcggcttcccagcttaaaaatgcggaattgacgtcaatgtgataaatgagcggctgcggcatatggtaatcctccttatgatggtgtattatagcagagaagtgaacaaaagtaaatgaaaatacaaacatatgttcctggaggaagaatgaagatccgtatctatgtcatgacacataaaaagtttgagatgccgcagagcccgctgtttcgtccgctccatgtgggacgcgcgtgcggggaagacctgggctatccgggggatgataccggagagaatatttccgacaaaaattgctattacagtgagctgaccgggctctactgggtgtggaaaaactgtcacgatgtggattatgtgggcacctgtcattaccggagatatctgctcggggcggatgagaggattcttatggaggacgattacgaaaagcttttatcagagtacgatctgattacgacgaagcaggttgcactcaataactcctactattacggtttttgcgccaatcataacaaaaaggcactggatgcggcgggagaggtgataaaagaacgttatccggcatattatccggcgtttgagaggctggtgcacggcacaaggacgtatttcgggaatatgtttgtcacgtcgaaggagctttatgattcgtactgcagctggctcttttccatatttgccgaggtggaaaaacggatctgtctggagacgggggaggatgcctaccataagcgcgtgttcggatttatctccgaattcctgctgctggtctgggtgacggtgcagggactttcggtgtgtgagtgcaaggtggggatgatcggtgagaaggcggagacgagagagatgaaagagcagcttgccggctattttgcaagacgcgatgtggacggcgccaaggcgtatttccttgagcgcagaaaggagcgcccggacgttttgatggaggcgtcggatgtgacgggagaactccggctttgcatgcaggtgatcgcaacggcgggaatggagcagacacgttacgggacgaaccttttagaacgcgaaaatcgtttcaaagagctgatgcagatgtttgaccgtctggaccagatcgtgtaccgctaccgcaacggtctgcagaaaaaagaggatgccgtctttttaaaggaacagggaatcacggacaccgcgcttctgatcgcactgcggatcccgggggatgatgcagcgcgccagaaggaactgtttgcacagattacggcagacaaaaaagcactggatggcaccaccgcagataccgttactgtgtgagttcacacaattttcagaaaagcttttgggataagcgttgacaaacaaaatgccaatgtgctagtatatgttcgttgcgatatgagtttttcagagatgcgcaatgggcaaccgtagtctaatggatagaacaccggactccgactccggcaatgcgggttcgattcccgccgggtgcatttttttgacagatatggcagagcagattgctctgccatagaatattagagaatctttgacaggcgagagactgtcagattggaacatctgtgcctgcagatatgcacacagatgatgcggtagtgcagcggatgacgaattgtttgggaaaggtacggtggagaatcaatggagaattccagtttgaatcatacagagaatcataagacagaggagaaggagacgaagagaacgccgattaagcagagaaaaaaggagaatgaggttctccgatttatccgggagcacatccggtattttgcggcgggagcgctggtggtcgttttaatcctcgtgcttgccatgtgtgcgaagccgaagggatccgactctgatgtcgtggtgaatgcgaacgcgacggagagcacgcaggcgacggaagaagcctatcaggtggatgccaatgagaatatcaacgcactgattacacagtattacacggcgtatgcggcgggagatgttacgacactttcctcgattgcaacaccgatttctgcaaatgagcagagctacatcggattattttcacagtatgtggatgaatatcagaatatcaagtgctacaccaagacagggctggatgcgaactcttatctggtttccgtgtcgatggagatcaagtttacgggagtggataccacagcgccgggactggatttcttctatgtccgtacgaacgatgacggcacgctttatattgacaacctgtacagccagtacaaccttgccaatcaggagaatgcgcttgacaccagcgtacagagcctgatcggtcagtttgagagcgagtcggatgtggtggagctgcagagtgaggtgcagacgagatacgatgaggcgcttgcagcggatgagaatctggcgaatatgattcagacgacgattcctgcagcaatcaaggactgggtgagccaggtggcggcacaggcggcaaccgagcagaccgaagcgaccgaggcggcggaacagccggagaccgagcaaccgcaggagacagagcagcaggaagagaccgtacagcagacagagacgcttgcgacgaaggatcgtgtgaatgtccgtgccgcagcggatacggaatctgaaaagctcggcaccttagatcagggaaccgttgtcacccgtacagcggtggacggcgactggagcgtgattgattacaacggtacgacaggttatgtcaagaatgagtttttgacctatgatctgccggatacgacggcggacaataattcggacagttcatcggataacagcgacagcacaaacagtgcttccatcgcagagggaacggtgattatgctggagaataccacgaatatccgctcgggaatgagcgaggattccagcaaagtcggaacggcttatgcgggagagaaggtcacagttgtgatgagttatgcggagggctggaccaaggtaaaatggaacggcgagaccggttacataaagacatctttattacagtaagcggtgcggcctggctgataccggaaaacggagactttttaaaaggaagtctccgttttttcacagagagaacatttgaaacggagagattatggacgaacagggagtgcggatcaacaaatatctgagtgaggcaggggtgtgttcaagacgtgaggcggaccgtcagatcgaggcgggggcggttaccgtggacggagtctgcgccagacccgggacaagagtgctgccggggcagacggtctgctttcaggggagaagcgtaagccaggaggaagaacgcatcctgctcgcgtttcacaagccggcgggaattgtctgcacagcggaaaaacgcgagaaaaacaatgtgatcgactatattcattatccgaagcgcatctacccggtcggaagactcgacaaggactcggaggggctgcttcttttgacgaatcagggcgatcttgtgaacaagattatgcgggcgggaaacatgcacgagaaggaatatctggtgacggtgaacaaaccgctcacggagtcttttctgcgcggaatggcaggcggcgtgccgctcgtggaactgaatgcgacaacacgccggtgctttgtggaacgcatcggcaagcgcgagttccggatcattttaacgcagggattgaaccggcagatccggaggatgtgtgaatatttcggctaccgtgtggaaaagctggtgcgcgtgcgtattatgaatattgaattgggcagtttaaagagtggaacataccggaatgtgacggaggaggagtatcacgaattgctccgcctgaccgcggattcgtccagcgatccggtgatgcctgcaaaaaagacgggggagaaaaagagatgacaccggaagaacagatcaaaaacctgcgggaacagattgcgtatcacagtgaccgctattacaatcaggataatccggagatatccgattacgagtttgaccagctgatgctggaattaaagcggctggagcgggaacatccagagctggtcacaccggattcaccgacccagaaggtgggcggcaccgcgaagcggacggcgggtgtgctggtaaggcacaatgtcccgatgctaagcctgcaggatgtgttctcaaaagaagagatctacgattttgtggcacagatgaaagaacagctggatgatccggagtttgtcgtggagtataagatcgacggactttcgatgacgctgcgctatgagaacggggagctggcgctcgcggagacgcgcggcgacggcatcaatttcggcgaggatgtcacggcgaatgcaaaggtgatcggcgacgtgaaaaagaagctccgggaggcaccggagtatctggagatccgcggggaagtctacatgaagaatgcggattttgatgccgtgaatgaaaaacaggagctgctcgggaaaaagccgttcgccaatccgagaaactgtgcggcgggcacgctccgccagctggattccgcgatcacgaaagagcgtaagctgtcgctgtttatatttaatatccagcaggtgcggggaatgcagtttgacacgcacacacagggatatgaatatctgaagaaacagggaattcatgtgattgacgattaccgtgtctgcaagacggcagatgaagtgtgggaggcgattaccgccatcggcgagaaccgcggcaacctcggctatgacatcgacggagcggtggtcaagatcaaccgtttctcggacagggagaagctcggggcaacctcgaaagtgcccagatgggcgatcgcctacaaatatccgccggaggaaaaagagacaaagcttttggacatcgaactgtcggtcggaaggacaggcaggatcacgccgactgcggtatttgagccgatacggctctgtggaacgagcgtttcgagggcgacgcttcacaatcaggactttatcgatgatctggatgtcggaatcggggacaccatcgtcgtctacaaatccggcgagatcattccgaaggtgaaggaagtgcggaaagaaaagcgcccggagggctggaagcgctttgtgataccggatgtctgtccggtgtgcggggcgaagacagagcgggaacgcgatacggcggacatcaagtgtacatcgccgaactgcccggcgcagctggagcgccacatcatcaattttgtcggaagagacgccatggacatcaaggggttcggaacggtttatattgaagaactcgtcagaatgggttatattaaaaatgtcgcggacattttttcgctgaaggagcaccgagaggaactgattgcacagggaatcatcggcaaggagaagaacacggacaagcttctggaggcgatagaaaaagccaagcagaatgatgcgtacaagctgttgaccggtcttgggataccgaatgtcggaaaggcggcagcgaaggcgatcatgaagcattttaagaccatggagcggctttcggaggcatccgaggaggaactgacggcagtcggggacatcggaaaagtcagtgcggactgcatccggagttatttttcggatgcgaagaaccaggtggtgctgcagagactcgcacaggccggcgtcaacatgacggcggaggagagcgagaccgtggactctgtcattagcggaaagacccttgtgttgacgggaaccctgccgacgcttggcagaaaggaagcgcagacgttgatcgagcggtatggaggaaaggtatccggatctgtgtcaaagaagacggattatgtcctcgcgggggagagcgcgggaagcaagcttacgaaggcgcaggaactcggcatcagagtgatcagtgaggacgaactgtacgacatgctgcagatagagaggtaacatttttatgccaatcagaatacagagtgatttacctgcaaaggaaatactggagaaggaaaatatatttgttatggatgagaatcgtgcgatgcatcaggacatcagaccgatcaagatcggaattttaaatctgatgccgctgaaagaagagacggaactgcagcttctgcgttccctgtcgaacacgccgcttcaggtcgatgtgacatttgttgcggtgtccagccatgagtccaagaatacgtcgatgagtcatctgaataagttctacgagagttttgcggatattaagagacgctattttgacgggctgatcatcaccggggcaccggtggagcagatggaatacgaggacgtggattactgggaggagatctgccagatctttgagtggacgaagagccatgtgacgtccaccctgcatctgtgctggggggcacaggcgggaatgtactatcactacggtctgaaaaagtatctcctgtcgcagaaaaaattcggtgtctacgaacaccgtgtgatgaaccggaaagtgccgctggtgcgcggttttgacgattactttatggcgccgcactccagacataccgaggtgcgcacggaggacatccgcaaagtcaaggaactgaccattcttgcggagtccgaggaggcgggcgtattcctcgcgattgcggacgagggcagaagaatctttgtgatgggacatccggagtatgaccgctacacgctggataaagaatacaagcgggacaaggagaaggggcttcccattgagccgccggtcaactattatccggacgatgacgatacgaaaaagccgaacctgcagtggcgctcgcacggcaatatcctttacagcaactggttaaattactacgtctatcagcagactccttatgagttcattgatacggcggagattataggaaagtgatgcggcgtttgccaaggcacggaaaagaggacataagatggcagatacaatgaagatggaatacaagattttcctggaggcggaggacgtgtcgcagtcgcggatcctttcctgtgcttcctacatgaagcgtgtgttagagagctgtaataatccttatatcagcagggcagaacttgatgacgagagcgatctggatgattttgtgctgcgccttttcgtggaggaggagatcgaggagaaggagtgcaccaacccggcgatggcggagagctttatcgaggatatggcggagcttgtgacggggattgctgaagcacattcgtttctggatctggagggaagcttttctgtcacatggaagggaacgacgagcgcatatgcctttgtttccccaggcggtgatgacggatgtgattttcaggaactcggtgtgaccgaataatttaatactttttttggtttccaaaacgggaatagtctgttataataaacgcataatatcacttaggaggcatttgacatgggtgaggatcgcaaaacatttaaaataaaggacggtaatttgggagaagtgaagattgcagatgaagtggttgccatcatcgcaggacttgccgctaccgaggttgagggcgttggttccatggctggcaacatcacaaatgaactggtaagtaagcttggtatgaagaacctttccaaaggaattcgtgtagaagttctcgacggaaaggtaagcgtggatgtggcactgaacatttcatatggttattcgatccctgaagtgtcagccaaggtgcaggacagagtcaagaatgcgattgagaatatgaccggtctggaagtatctatcgtgaatatccgtatcgcaagtgtggacatgggcagcaacaagtaacgcatcgaatcacggtgaataagataaaggatgtccctgcgacatccttttttcctgtacagggaaatgtgacgaagaagacggggacatgagagaaaggaaaggtttatgaccagaagagagttgagagaacagatatttaagctgttgtttggcgtggagttccatgacagacaggaactgccggagcagattgccgtctatgaggagacggaggagccgtgggatacaaaggacggcgcatacatctccggcaaatgcgaggatatcgtggcacatcttgcagagattgacgaggcgatcgatgcggtggcggaaggctggaagaccggacgtatgggaaaggtagatctcacgctgatccgcctggcagtctatgagatgaagtacgatgaggatgtgccggtcggcgttgccatcaacgaggcggtggagcttgccaaaaagtatggcaccgatgagtcgcctgcatttatcaacggtgtgcttgcaaagctggtatgagaaaaaatatctattctgtcggtcaggtaaatacatatatccagaacatgtttgcacaggattttatgctgcaccagatcagtatcaagggagaagtatcgaactgcaaataccactccagcggtcatatttattttaccctcaaggatcagacggggacgatcgccgcagtcatgttttccaggtaccgccgcggactggcctttcagatgaaggagggcgataaggtcgttgtgaccggctccgtggaggtgtacgagcgggacggaaagtaccagctctatgccagagagattgaacttgagggcgccgggaatctctatctgaagtatgaggcgttaaagcgcgaactcgaggagatgggaatgttcgatgcggcatacaaaaagccgataccaaggtatgccacgaggatcggtattgtgacagcacccacgggagctgccatacaggatatccgcaacattgcagccagaaggaatccctatgtgcagttgatcttatatcctgcgctcgtgcagggggacggcgccgcagcaagtattgtgcgcggcatccatgcactggatgtgctgggtgtggacgttatcattgttggacgcggcggcgggtcgattgaggatctgtgggcattcaatgaagaagaggttgcgcgggcaatttttgcatgcaacacgccggtgatttcggcggtcggacatcagacggatacgacgatctcggattatgtggcagatctgcgggcaccgacaccctccgcggcggcggagcttgcagtgtttgatgtgcagctcgtcgaaaagtggctgatggactatggcacgcagatgagacgacagctggaattaaagctgaatcagatgcgcacacgcctcatgcatgatgaggagaagctgcgctatctgaatccgcgcaccaagctgaaggagaatgaaaagcgtttggatgagcttggcgctgccttagagcgccggatgcaggcaatactcgaacagaagcgccataagctggcactcctttcgggaagcctggatggaatgtcgccgcttaagaagatggcacagggatattcttatgtggaggatgccggcggacatgcattgacggatgccggcactgtgcagatcggagaagcgctttccattcatctctaccggggcagcctaaaggcggcggtgacagagatctgtaggcaggatgtcgcagcggatggttcggagaaaggaagaatcgatggataatcagaacgaaaaaaagccgacgcttgaggaggcttttacccagatcgagacgatcctcacgcagatggaggagccggagatttcgctggaggaagcttttgcgctgtatcagcagggggttctgcagcttaagaattgcggaaccattctggatgaggtggaaaaaaagatgcagatcctcggtgaggatggggaaatagaagagatgtaagaacggtagggggatgcagatgatggattttaagaccgagatggcggagcgcacagcgcagattgaacagatcataaaaaaatacctgccaaaagaagaaggctatcagaagaccatcatggaggcgatgaattacagcgtgctggcgggaggaaagcgtcttcgcccgatgctgatgcaggagacataccgcctgtttggaggaagatccgaggtgatcgaaccgttcatggcggcgatcgagatgattcacacctactcgctggtgcatgatgatcttccggcgatggacaatgacgaataccgccgggggaagaagaccacgcacgccgtgtacggggaggcgatgggaatcctcgcgggagatgcgcttctaaattatgcatacgagacggcggcgcgggcattcgccatggaaccgggcaatcccggggtatgtcaggcatttcagattctgaccgcaaaggcgggaatctatggaatggtcggcggtcagacggtggacgtcgagtcggagggaaagccgggcatgaccaaggaaaagctcgattttatctaccgtctgaagacgagtgctctgatcgagggggcaatgctcacaggagcggtgttggcgggagccacgcagggcgaacagaagattatcgagcagacagccggtgaggtcggacttgcatttcagatccaggatgacattctcgatgtcacgagcaccatggaggtattgggaaagcccatcggcagcgatgagaagaaccacaagattacgtacgtgacctatgagggcattgagaaggcgaaggcggatgttgcgtcgctatctgagcaggcgattgcgcggatggattcccttgtggttaagaacgaatatctgacggaactgctcagatatctgatcctccgggagaagtaaactacgataaaaagcagaggtgctctgtatgatcttggaacgtatacaaaaagaaaatgatatcaaggaactctccgatgaggaactgaaaattcttgcatcggagattcgtcaatttttaatcgagaaaatctcggataccgggggacatcttgcgtctaatctgggcgtgatcgagctgaccatggcgctgcatctgtttttggatctgccgaaggataagctgatctgggatgtcgggcatcagtcttatacccacaagcttctgaccggaagaaaagagggatttgaccagctgcgcaagtacgggggaatgagcggattcccgaagcgcaaggaaagcgaatgtgactgctttgacacgggacacagttccacgtccatttcggcgggactggggtacgcgcatgcgagagagattaccggggagaattacaaggtggtgtcggtgatcggagacggtgcgctgaccggaggtatggcgtttgaggcgcttaataatgcggcacagcttaactccaactttatcattgtcctaaacgacaataatatgtccatctcggagaatgtcggcggattgtccacctacctggcggggttccgcacggcggatgcctaccgggatttaaagctcggggtcatgaattccctcaacaagattccggtctacggcgataagatggtggagcgtatccggcgcacgaagagcggaattaagcagctgttcattccggggatgctgtttgaggaactggggattatttatctcggaccggtggacggaggcgatatcaagggtattttaaagctgctgcaggaagcgtcgcgtgtggatggaccggtgctggtgcatgtcatcacgcacaagggaacaggctatgcacctgccgagcggcatccggcgcggttccacgggacagagccgtttgatattgagacaggacttcccaagcatccgcgggtaaaagcaaactataccgatgttttttccacggtgatgcgcaagcttggtgaccgtgatgagcgcgtggtggcaatcacggcggcgatgaccgacggaacgggattaaaacgtttccacaatatgtttccggagcgcttttttgatgtgggcattgcggagcagcatgcggtgacgttcgcggcggggctcgcggcgggaggcttaaagccgatctttgccgtgtattcatcttttttacagcgcgcctacgaccagatcctccacgacgtctgtattcagaacctgccggtggtatttgcgatcgaccgtgcaggacttgtgggcagcgacggggagacccaccagggaatttttgacatctcctatctctcaacgataccgaatatgaccattatggcgccgaagaataaatgggaactgtcggatatgattaaatatgcagttgatttttccgcgccgattgcgataagatatccgagaggagaggcgtatgacggattaagagagtaccgggcgccgatcgcctgcggcaagagtgagtggatctaccggtcggggaagatcgcgctgtttgcacttggtgcgatggtgaagacggcggaggcggtgcatgagcggctgaaggcgctcggctatgagagcagcttaatcaatgcgcggtttgcaaagccgctggatgaggatgcgctcctgtccgcagcaaggcatcacgaccttatcgttacgatggaggagaatgtgatcagcggcggcatgggcgaacaggtcatgcgtttttatgaggagcacaatctctctgtgagagtgcttgccatcgcgattccggatgagtacgtggaacatggcaatgtggagattctgcgcagggaagtcggaatcgatgcggagacgatcacggagcgcaccatagaggcatatgaagaactgcacgcacaggaaagcggtgcggaaaggaatgacttttgaaagaacgattagatgttttgcttgtaaacagaggactggctccgtcgagggagaaggcaaagaccatgattatggaaggcaatgtctttgtggagaaccagcgggaagataaggcgggggctacatttgacacggaggccgagatcaccgtaaaggggaatacgctcaaatacgtgagccgcggcggattaaagcttgaaaaagccatgacgcatttcggaatcacgctggagggtaaggtctgcatggatattggagcttccaccggtggatttaccgactgcatgctgcaaaacggagccgtcaaggtgtattccgtggacgtcggctatggtcagttcgcatggaagctgcgccaggatccgcgcgtggtctgcatggagaagaccaatatccgctatgtgaccccggcggatatcgatgacgtgctggattttgcgtcggtggatgtgtcgtttatttcccttaccaaggttttaatcccggcacgggagctcttaagagacggcggcgagatggtctgtctcatcaagccccagtttgaagccggacgggaaaaagtcgggaaaaagggtgttgtgcgtgacaaggctgttcatgaggaagtggtagagcggatcattgaattcgcgtcacagaacggattttttgtaaagaatctggaatattcgcccatcaagggaccggaaggaaacatcgagtatctggtgtacatccggaaggatgagacgggcggcgtggatgcggcagtcgacattaaggcggtcgtggatgcagcgcacggcgagttagacaagtaaccggacgtctgtgaatgaccgggtgtctgccggatgtggggaagcttatgagacattttttgatcatcacaaatacatataaggacgagaacggcagactcaccggagaacttgcggcgtatatccgcaaaaagggcggagaatgtgactgcttttacagtgacggggagagcaaaagcgaggcggcgcctgctttggataagatggatccagcgacggactgcgtcatggtgttaggcggcgacggaacgctgatccgcgcggcatccaggctagtggacagcaggattccgttgatcggcgtgaaccttggtacggtcggttatctgtgtgaactcgaggagagcaacgtgtttgacgcggttgaccgtctgatggcggatgactgtatggtggagaagcgcatgatgctcaccggcgcaggcatccttggcggagtgcgggaagaatacggggttgccctgaatgatatcgtgattcaccgcacgggggagttgtcggtagtcagcctgatcgtctatgtgaacggggagtatctgcatacgtttcgggcggacggaatcattgtgtcgacgccgaccggttctaccggctacaatatgtcggcaggcggaccgatcgtggatccgaaggcacagatgattttaattacgccgatcaatgcgcataatctcaattcacgcagtattgtgatcggtgcggaggacgaagtggttgttgagatcggcagaaggcgctcacagaaggatgagacgctggaggtcagctttgacggggataccgccgcaagacttgtggtgggagataagttcagtatccggaaggcttcggacacgacaaggatcttaaagctgagcaacaagagctttctcgagatcctaagcaaaaagatgcaggtatacacataagcgggaaacggagggcagaatgaaaaccaaacgacaggcgaaaatgctggaactgatcaagagaaatgacattgaaacacaggaagaactgtcggattatctggagcgtgagggctatcaggtaacacaggcgacggtttccagggacatccgggaactaaagctcaccaaggttgcaatgagcaacggcaggcagaaatacgttgcgctgcaggagacggacgaaaatctgtcgcagaaatatgtacgcgtgttccacgacggatttgtatccatggatatggcgcagaatattctggtcattaagactgtctcgggtatggcgatggcggtggcggctgcgttagatgccatgcatatgcacgagatcgtgggctgcattgcgggggatgacaccatcatgtgcgcgatccgcagtgtggatgataccgttgcggtgatgaatcgcttgaaaaagcttgtggaagactagacgggattcttttggggagagtagaaggagattctatgttacaaagtctgcatgtgaaaaatctggcgctgattgacgaggcggaggtggattttacccggggactcaatatcctctcgggagagaccggtgcgggtaagtccatcatcatcggttcgatcaatctggcgctgggtgaaaaagtgcaaaaggaaatgttgagagaagatccgcagaccggggagtttgctccggcgctggtagaactggtatttacggtggagaacgggcaggaacggcaaaagctggaggcgctcgaggtctatccggaagatgaccaggtgatcctaagccgcagaatcgtaggcggaaggggaacggcgcgcgtcaacggtcagagtatgccggcatccgcggtgcgcgagatcgcggcgattttaattgacattcacggtcagcatgagcatcagtcgcttctctcaaagcgcagacatttggagattctggatgcctatgtgggagagacgctgacagagaaaaagaaggcgctcgcagagacttaccgcagctacaaaaagctggtggaggaagagaaaaatgccggcatagacggcgcagagcgcgagcgggagatttcgttcctggagtacgagatccgtgagatcgaggaggcaggacttcgggaaggcgaggacgaggaactggagaatgagtaccgccggttttccaacggacagaagattgtgaatgccgtaaacggtgcatacagcaataccggcggcgaatcggactgtgcgtcggaactgaccggaagggcggtgcgcgaactctcgtcagtctccggatacgatgagaaacttgccgaactcgagcgtgagctgcttgagatcgacgggctgttaagcgatttcaaccgggaacttgccgattatgtcgagaatatggagtacgatgaggagacgttctaccaggtggagaagcgtctcgatgaggtaaatcatctgaaatccaaatacggcagcacgatcccggacgtgcttctggcattagaagagaagcaggaacgcctgatgcagcttaaggactatgacacgtatcttgccggtcttaaggaagagattgcgcggaccaaaaaagtcttagagaagcagagcagcgaggtgtccgcaatgcgtaaggaggcggcagagcggcttaccgcggcggtcacgcaggcgctactggatctgaatttccttgatgtgcgttttacgatgaattttgagcgcatggcagagtatacggcgaacggattcgacgatgcggaatttttgatttccacgaacccgggcgagccgttaaaaccgctcggaaaagtagcgtcgggaggagaactttcgcgtatcatgcttgccatcaagacggtgttagcggatgaggatgcggtggagacgctgattttcgatgagattgacagcggaatcagcggacggacggcgcagatggtttccgagaagatgaatgtgctgggacggtcacatcagattatctgtatcacacatcttccacagattgcggcgatggcggattcccattacctgatccagaaatccgtacagaatcagacgacagtctccacgatccgcagactgtcggaggaggagagcatacaggagctttcccgtatgcttggaggcgtggagatcacggagacggtaaaagagagtgcgagagagatgcgcgcgcttgcaaaaagcaaaaaaatcggggtttgaaaagtaaaaatattcacataataaaagaagataccacaggtatgagataccatggtatcttctttttttgttgtgtggcggcctttgggttacagaaaatggtatgggggcagatatgagacataaattttattttttgatacagcagatcacgtgggttgtttttttgtttttgacgctgtttgccgtaaagacgtttgagcgggcactgccggatgagatctacgttccgttcggggaaaaggcggattaccggtttggcgttccggtgagcgtgacgttaaaggacgacagcgaggaagtgttctaccgcttaaacgggcaggaggatgccatggcggaggcccctttttataccgttacctgcaagctgttcggcattttcccggtaaaagacgtgaaggtgatgatggtcgacagacaggaggtgactgcgggcggcgaggcgatcggtatctatgtgaagacggacggaatcctggtgctcggcactgcaaagattgcggatgcgtggggcaatgagtgcagcccggcgcagaatctggtgcagagcggggattatattgtgagcgtgaacggggagacggtgtgcgggaaagaggagctgatggacaagattgacagctacggcagcggacgtgagatcatcggagtgatgcggaagggggagtatgtggaagtatccatgaatccggtcaaaggcgagacgggaaaataccgccttggaatctgggtgcgggatgatcttgccggggtcggaacactgacctactacaggcaggacggcagctttggcgcactcggacatgcggtgagcgacggcgacaccggcgtgcagatgagcctgtcggaaggatatatttacgagacgaaaatcgtcagcatccagaaggggaagaacggcgtcccgggcgaacttgcggggatcattgactacgggaaatcgcattgcatgggaagcattacggagaactcgccgcttggcatccgcggcatgttaaatgatacggcgggagaactggaaggagaagtctacgaggtggcttataagcaggacattgcgcttggaaaagcctacatcatctcggaggtgtccggggagcgcgcggagtatgagatcgagatagagagtcttgattacagtggggatgaggaaaacaagggaatcctttttaaagtcacggatgagcggcttttaggcctgaccggaggaatcgtacaggggatgagcggcagtccgattatccagaacggaaagatgatcggggcggtgacgcatgtgtttgtgtcggatgcgtcgatgggttacggaatctttattgagaaaatgttgtgattgcacgacaaaaacttttacaacgtctggtacttatggtatactacagtcagtattgttggctttaaggacggaagacggaatggaacagcaggaacatatacaaaaactggcagatgaatactacgaagagggcagagccagattctttgaccacaagctggaggaagcggcgatgctcgtacagaatgcgcttcatctctacaagaagtgtgatgatatgctaaaatacgccacagcgctcaatatgctcggtgtgatctacggtgccacggggaacgagacgatggcggtggattatctggttgagggacttgagtgtgcgatagattaccagctaaataacatcacggcactcttttataacaatatcggttccaggtaccaggaactgggagaacatgagaaggcgatcgattatttcttaaagtcggcgcgggaactgcagaatccgacctgcataaaggaggagcgctaccgttcctggactctgattacctacctgaatctggcggtctcctactacgaactgaatctgtacgagctttcctacaaatatttagagcaggcagagcggcagcttgacgaggaagtggaggagatgtatcattatacggtactgatcttcaaatgtaggctgctctggcagatggaaaagggagactatgtgtatgagcacatggaggatcttctggcgagcggtgaaaaagacagcaatgcatcggattatctgagcgatatgaaggatctgtgtcagttgttccgcgacatgaaagagtatgaatactggaagcagaccatatctgcggtcgagacctatacgatcgatcagaataccgtctttttccggctttttctgacagaattgtggatggactactatcagactgtggggaacgaagagcgctatgtggaactgtgtgtggcacatgcggatctgtataagcgccagaaagcaatcgatgtgaaggatcgtgcaacagcgatcgacatcaaggtccagctgcgggaaaaagaggcggagcgtaagcgcgtggagaccatgtctgtgacggatgcgctgaccggactggggaaccgctattctcttgagcgtgaggcggtgcacatcataagggatgcgggcggtgagcggatcacggtcggcgttttggacatcgactgctttaagcagctgaacgatacctacggacatattcagggagaccgctgcctgaaggtggtggcggatattctgaaggaggcagtgatggactgcggacatgtctaccggtttggcggggatgagttcgtgatgttgtttccggcagggatggagaaccggatcgaggggatcgcggaggcgatcctgcagaagattgcggaggcgggaatcgcaaacgagcactcggttgtgcagccgaatcttaccatctcccaggggtatgcctgctttgtgccggagggcacagagagcggagcgcgtctgattgagcacgcggacaaggcgctttactatgtgaagagaaacagcagaaacgcatattatatcatacgcgaatgatgcatatacttcagttgacgactagcttcgacaaattttcttgcgttggaatcagtatcatcagtaagcaaagagttttgtcacaggaggggctaaaatggaaaaactgaatgttgcaatagcagatgataatgagagaatgctgcgattattaggggatattatcgaaagtgatgacgaactgaatgttgtaggagtcgcccgcgacggcgaggaagcataccatgtgataaaggcgaaagaaccggatgtcgtgctgctcgacattgtgatgccgaagcttgacggattgggggttttagaccgcgtgagtcaggacacctccataaaaaaacatccggcgtttattatgatcagcgcgatcggtcaggagaaaatcacggaagatgcgtttgcgcgcggcgcagattattacattatgaagccgtttgacaatgatatcgtgttaagccgcatcaagaatgtgagaagacctgcggcgggacgcggtgcggaagtgcgcaaggtcaatgcctatgagaaggcggaggagacaaaggagcgcaacctggaagcggatgtcaccgatattattcacgagatcggagttccggcgcatatcaaagggtatcagtatctgcgggatgcgattgtcatgtccgtcaatgacatggatatgctcaactcgatcacgaaaattctttatcccacgatcgcgaagaagtaccagacaacctccagccgtgtggagcgggcaatccggcatgcgatcgaggtggcgtggagcagaggcaagatggataccattgatgagatgttcgggtataccatccacaacggaaaaggaaaaccgacgaattcggagtttatcgcactgattaccgaccggatacgtctggaatataagatgcattaacgatgaggacatatttttcaggaggcgcaaagccgaagaagagtatgtcctcattttcggataaccggttccttttgagcgtcagatgtgctataattatacgatgatttttcggaggatggcagatgcagaaaaacaggtatcagctcaggtgcgcggcaggaaaatactggctgttagatatggagcaggatggagaaacgtatcggccgccgctcatgttaaatgagagcggggcttatatcttcaggcagtatatggcaggaaacacggcggataaaatcgcggaggagcttgccactatgtacggggggatcgcagacgatatgcggacagatgtgatgcagtttatcagacaaatggaactacaggggatcttgtaaacgatgaatatattattggtgggaagcaaatgccgcttccttcagcttttgacggacaaactggacaaagaagggcaccgtgtgtttttgctgacggcagaagacaaatcggtcagaacgtccaaaaagatatttgagacgtatcattttgcatacgacaatccgtgcatcagagaggtgcttgagggagtgcgtccggatgtgacagtctttatgggcgcctatgatacaggctttctctgggggaaggggagcagcacggcgtcggcgtacacttcaggcctgtttcagctgctgatgaatgagacggctggtaatgtgggacgctttttgtatctctcgtcggaggaagtcttcgggggagagtatacacaggacatttcgtgcgaggaaaactgtgcggcttatacggtacgcgcgcaggcgattgcggcgggagaggaactctgccgcagttactttaacatgggctatgagacgatcgtgctgcggctggatcatctctacggggaaccgcttaccggggcggaagcgcgtgatatctgcgcccgcatgagtgtggaggggctggaaaccggtgagatccgggtaaatccccacaaccgtgtggcgctgttacactattcggatgccgtcgaatttttgtatgcggtgattacggcaaaaaagatgacgtacggcgtctatcagatttcttccggagagacgatttccgttcgaagcgcagcggagtttgtggcggcggaactggaaggtgtgaaagtcgtagaggacaccggaagagagcggatggagccggttttgtccaaccagagatttgcggaggagtttgggatacgcattgtacataagccggagaccgagattggcagggaggcggcgtacatccggcagcacgcatcttcttttgtgcggacacagagcagaaaaaagggatggagccggttcggagagcggtcgagagaggccgtaagagcgatgattccgttcgcggagaatctgctttgtttccttccgtttttcctgttaaataactggatggcggggagcgcgtatttccagaacattgatttttaccttctgtatgtgctgctgttcgccattacctacgggcagcagcaggcgacattctcctcgattcttgcggtggcggggtatcttgcggtgcagatgtatcagcggagcggttttgatgtggtgctggatgtcaacacgtacatatggattgcacagttgctgattctgggacttgtgatcggctatatgcgcgaccggctgcatgcggtggaggaggaggagcgccatgaggtggatttcctctccagacaggtggaggacatctcggatgtcaacggcagcaacgtgcgcatcaaggagattctgtcaaatcagatcgtcaaccagaacgacagcttcggaaagctgtatgagatcacgtccagcctggacaagtacgagccgagcgaagtgctgttctatgccgcggaggtgctggcaaagctgatggacagtcaggatgtcgcaatctatacggtggcaaaccactcctatgcgcgtctgttctcggcaacttcgccgaaggcacgcatgctcggaaattccattcactatgtgcagatggaagaactctatgaaaagctgcgggagaaaaaagtgttcatcaacaaaaccatggatgagcgctatccgctgatggcggatgccatttattcggaggatgagatgcagctgattctgatggtgtggggaatcccatgggagagaatgacgctcggacaggcgaatatgctcactgtgatcggctatctgatccagaacgcggttgtacgtgcgaaccgttatctctcggcgttagaacagcaacgctatatccacggcaccagaattttggaggcggatgcgtttgcttctctggtgaaggcttatcttaacgcgagagagaagaaactgacggagtgcgcgcttgttgtctttgaggagggggagatctccagggaggaagccgcgggcgtgctttccggcatgatgcgccagagtgattaccttggagaactctccgacggaaagatgtacgcactgcttgctaacacgagcgcagaggatgcgggaatggttgtggagcgttttaggagcgcaggtttcccgtgcaggatgaaagaggagatggaactatgagcaggatcgaaacgtattttctgctgcttgtggtactgaatctgtgcgtcacggcggcgtatgtcctgtggaatgagcggcactggagagaagagcccggaaagcgcaccggcggaagaatccgcgcggcggttatgttttttgcgcctgtgatcggtcctgttttctttgtggcgggagagcttgcgcggcatcttttattcggacagtcggcggatctggaagatgttattttcagcaaggagcgtgtcagaacgcactttatggcggacgaggagcaggagcggaatgtggtgccgatcgaggaggcactggcgatttccgaccgggacagcctgcgcacgctgatcatgaacgtggtcaggggagacgtcacggactctctcggatcgctggcgctggcacttgacagtgaggatactgagacctcccactatgcggcgtcggtgcttcgggatgtgctcaatgatttcaggcagcatgcccaggagctttaccggcagatgcaaaaggacggcagggaggcgggggatgatgcctgccttctgatcgagtacatgtacgtcgtcttaaaacagaatgtttttcacgagaccgaacagcggacattcgtggatatgtttgaggaggcgtgtgaacttctttatgaaaaggattaccgaaagctcacggcgcaatacatcgaatggctgtgtgaactgctgctccgcttaaaggaattcgggcggatgcgctactggtgcaaccggagccgggaattatatccggatgcgctttccacgtacacctgctatttgaaaatgtattttacgcaggagaagaaaaccgaatttttccgggaactggatcggctgaaagcgtccaatatcgtcattgacagggagacgttagagctgatccggacgttcagttagtccggcaggaaggaaatgacatggtatcacgcagaaattatctgacgattgcaatgatgtttgtgattctgctttttatgtttcagtttacaggcgtcatgaaagaacagttaagtgaatatgagagcaacgaatatgcagacgataccacaacatcctttcaacggtcggatgcatttctggcggaacagacatctgccgacgcctgcgaggtgatctatgtgggcgaagcagggggagcggaggaatccgtggtaaagacatggtgcagctaccgcaagcggacgtttttttgcagcagctccctcgcactgcttgacagcctgcaggatgatgcactgcaggtgctggtggtggacggcagcaaggtgacgtcggaagaagaggtggcggttcttcgcagagaggcacaaatgggtgtgactgtgatttttgcaaccctgccgcagagctctgtgataagggagtaccgggatttaagagagcttctcggaatccgcgcggtgattgcggatgagataccgcttgcgggcatgcatctgttttccggctttctgctcggcggggaagagatctatgaggtcacggaactcggggaggaggagcgtcaggacatgaacccttctgttccctggtatacgaccggcgcgggaaccaagacctatatggtcggcacgctgtccgatgagacgatcgaacagacggtggataacgaaatacgggcacagtatgcgggaatggaggaagaggcggcaaaaaacagccttctgcctgccattctctggagaaacagcgtggatacggcaaagattttctgtgtgaacggggattatcttgcagacataagcgctgttggaatactggacgccatgatgggggagacatacgattacgatatctacccggtaatcaacgcacagaatcttgtgattgcagatctgccgacgttcgtctccgagaacgaggaggagatgcagaagcgctacagtcagtccgcacaggcagtgtatcaggaaattgtgtggccgtcgctgacctccattgcctcccggacgggggcaaagatgacctgcatgatgacgccgcagtttacgtatacggatgaggaagagccggatggagagaacgtcacctactatctgaaacgtctgaaggaggagcacgcggaggcgggactgtccgcagacagcatggaagggatcccgctctcagaaaaaataaagcaggatcagacgttctggcagacctatgcgccgtcctaccggtttttatccctctacgcggacggagtaaagagcatcggggagaagagtgcccttccagcggaaatccggacggttgcgctcggatccggcgccagcgggcaggcggtggggtatctcaatgagaacgtcacactgcagccgtcgacgagttccggaatccggcatacgtttctggatgattttaaagtgaaatgcatggagacggcgctcggctattccaacatcacactcgacttctatagcgtgacttatccggaaggggacgaggattcctgggagaaaatgtccaagaagatcgcagcaaacctgggcacctactggaaagcgtatgaagcgtttgacgcaaccaccctgacagagagtgatgtgcgcatccgcagatttctggcacttgactataagcagcagcgcgcgggcaatgtgattacgctttccttagagcaccgggaggatgcggcatggtttctgctgcgcctgcacggagagaaagtcacagaagttgcgggcggaatctttgaagagatagaagacggcgtctacctgattcttgcagaggaagatgaggtctccgtggaagtgcagaccggggaaacatggcagtatcaggacggcggaaagcgtggtgacggcacatgagaatatgtattgtggcagagggatgctatccctatgttgtcgggggtgtatcgagctggatacacagtatgataaaaatatttccggagtaccagtttgtcgtgctggcgattgtggcgaaccgttcgctgcgcggaaagtttgtctacgatctcccggagaatgtggtggaagtgcacgaactgtatctggaggatgcagactggcggccaaaagaacttaaaagagcagccagactgaagttaaatgagcgggagtacgccgcactgcggagcctgttgatgaaccagaatgtagactgggataccctgttctcctttttcggggagaaggaattctctttgaatgaacttctcatgggggaggattttttccgggcggtgcaggaatgttatacggtgcggtatgcgggggcggtgttttctgatttcctctggacgatgcgctccatgtatcttccgctgtttctgacacttggcatgcggctgccgagggcggatgtgtatcactgtgtggcgacgggatatgcgggcgtgctgggcagcatggcaaagcgcaggtttggctgcaggcttctgatctcggagcatggaatctacaccagggagcgcgaggaagaactgatccgtgcggactgggtgtccggcatctataaaaatatctggattgagcagttcaagaaaatgtcgaagcttgcctatgacagggcggatctggtgacaagcctttacgcgcacgcgagagagcttcagatcgaactgggatgtcctgcggataagacgagcattaccccgaatgggattgatccggcgcggtttaccggcttgaagcgtccggaagcgatggagccggatatggtgcacatcggtgcggtactccgcgtgacgccgatcaaggatgtcaagaccatgatccgggcgtttgcgtatgcaaagcgcgatgtgcctaacttaaaattatggatcatggggccgacggaagaagacgaggaatacgcgagagaatgttttgatctggtggagctgatggaactgccggatgtggtgtttaccggaagggtgaatgtgacggaatatctcggcggactggattttaccattctgaccagtatcagcgaggggcagccgttaacggttctggagggctatgcggcgaagcttcctgcgatagcaaccgatgtcggaaactgccgcggactgttgtacggcgaggacgatgattttggcgaggcgggaattctgacgcacatcatgaacgtgaaggagatcgcggatgccatggtgaatcttgccagacatccggtccgcagaaaacagatgggagaaaacggttaccgccgtgtgatggcaaagtacaagatttcggatatgcagcagacgtaccggaagatttatgaaacgtttgagaacatagactggtagaagggagagagactgtggcaggaataggaatcaagctccagaaaatatatgagaaaaaaacgattcttgcatatctgaccggattcggctacagtgcggtcgtgacggtcgcaccgatgtttgtcgtgatcggaacggtcatgctcatgagtcagctcctgggatatgagaatgtgggatatgcgaggagaggactgttttccggaacgctgctttacatctttatcttttcgcttctgacggcggcgccttttaatgcggtgttgtcccgctatatgtcggatgtcatctatgaggagcgctatgaggatattctgccctgttacgatgtggggctgcttttaaacattctgctggcaagtcttctcggaattccgttttgcgcatgggaacatcttgtggaacatgtcaatctgatttttgtgtttaccggattttgcggttatatcgcactggttctcgtgttctactcgatgctttacctttccatctgtaaggattatcagaagatatcgctgtactttttgaccgggatggcggcggcactcgcctgcgccctcttttttgtaaaagtatgcggcagggagattgtctacagtatgctgctttccctcacgatcggattctttcttacggcggtgttggaatatgccacggtgaagcgctattttaagaggaacagcaaccggtacagaagagttttttcgtattttggcaggtactggaagctggtggtgatcaattttttgtataccctcggtctgtatattcacaattttgtgttctggaatacggatttacagatgcgcgtggcggatacgtttgtctttgctccgacgtatgatctggcgacctgtctggcgatgtttacgaatctgtcgtcgaccatcatttttatcacgcgggtagagatgcatttccacacacgttacaaggcgtattcggaagcggtcatcggaggaagatgggaagatatcaaaaatacaaaagacagaatgttccggcagctttctgcagagcttatgaatctggtgcgcatacagtttatcatctcgacggcagtgtatctgctctgcgtggtggtgcttccgcagtacgggttctcgggaagagtgatgcagatctatccttgtcttgccgccggatattttatattatttattctgtatgcagaaattatttttctgtactactttaacgatctgacaggggcgcttttggcaaccctcggcttttgtctggtgacgtgggcgggaagcgtgctttctgccggcgggagtgacctgtggtacggcatggggctggtggcgggcagctttaccggctttaccattgcctatttcagactcaggttcatggagcgccatatggatgaacatatcttctgcggcggacagctgtttacggtgaagagagagcggatgccggagagtatggtatatacaaagaaacagaaggagcgttagtatatgaatgtgattttaattctgcggatttttctgacggcagcgggagtgttgttccttttgggggacatcaatgcgtatgtgagacaaaaactgaccgatacgattggacttctgtgggcatttgtctcggtggcgctgattttaacgggcgtggtctccgtgccgggggcaagggaggaggaatacctggtggtgcttcttctggcagtctgcctgctgcttttgatcctgctgtttaagttaagcaaggtggtgtcggttctttccatgaaaaatcaggagcttgccatgcaggtttccctgctcaatcaggaaaatgagagaatattgcacaggctggggattttgacagatgaaaaaaaagatattgttcgtgattaatacattaagccgcgccggagcggagacggcactgttggaactgcttgcgcagcttgctgccgagaggggggaggacgggcagcccagatatgagctctcgctctttgtcctgatgaaccagggagaactggtgcagcagataccagagggggtgcggcttgtcaatccaaggtatgccccggtctcggtgctcgaaccaaagggaagaatctatatgggcatgaccgttgtaaaatgtctgcttcacagagccaacctgatccggctgtggcgctatcactggagggtcgcgcgggcaatgcgcaaagagggacggctgatgccggacaagctgctgtggcgggcaatctcggatggcgctagacgcttcccggaggaatatgatcttgcagttgcattcctggagggcggttctgcatactatgtggcagaccacgtcaggacgaaaaaaaaggcggcgtttattcatatcgactatcagaaggcgggatacagcagggaactggaccgcgactgctacctgcaatatgatgccgtatttccgatcggggaacaggtaaagcgggcgtttctcgccgtgtatccggagtgcagtgcacgcaccaggatctatcacaatcggatcgactgtgaaaaaatccggaagatgtccgggcagccgggaggatttacggatgatttcgacggaatccgcctgcttacggtgggaagactcaccccgcagaaggcatatccggttgcgatcgaagcgatgcggcagttaaaggcggagggatacccagtccggtggtatgtgctgggcgagggaagcagccgcagggaattagagcagcacattgcgtcgtgcggattaaaggaggatttcctgctgcttggagcggttgagaatccctatccgtactaccggcagacggatatctatgtgcatgcgaccggatatgaggggaaaagcattgcgatacaggaggcgcagacgcttggctgtgcgatcgttgcttccgaatgtaacagagagcagattacagacggggaggacgggattttgtgcgcgcttgacgctgcggcggtaaaggaagctgtgggcttcctgatccggaatccggaccggcgcagggcgtacgcgcaggcggcgttaaagcgtcctgtaaattacgagaacgaggaacggctgttggagcagctgctttccgagaaagaataaggaagatacgatggtagagaagaaacaaaaagaactgctgattatcattccggcatacaatgaggagaaaaatatagagcgggtgctggaggagctggaacgcccggagatcgcggagattgcggatattctggtcatgaatgacgcgtcctcggactctacgaactgggtcgtaaaggcacacggacatacgctggtatcccatgtctttaatctggggtacgggagcgccctgcagcttggatataaatacgcgatccgccgcaaatattcctatgtgatccagatggatgcggacggacagcatgatgtgtgcaacataccggtgatctatcagagactaaaacagcaggatgcggacggacgctgcccggatatcgtgctttgttcgcgttttatggagggaagtgcagagtattcggtctccgctacgaagaaactggcatacggattcttccgctggatgataaagatcagtaccggacgaaagattgccgatccgacgaccggtctgcagggacttaaccgcagggcatttttatattactcgaagtataagcactttgacgacaagtatccggatgccaatatgatcattcagatgcagctgctcggattccgcatagatgagatccctgctgtcatgcatgcgagaagctgtggcaccagcatgcactccggactcaaaccggtggtctatatgttccgcatggtcttctccatcatcggcgtggtatttcggatcaaggtgcttggaattgatgcgggggcaggagagcgggatgttttcatggacaaaaaggagtaagcgttctttttacgcagaaaatttaaaaagacagcagaagccctatattgctccggggcgtgggtggtatcacatctacacgttccggctggggagaccggagaaagtatccttagactggctgccggattatcccggggagacacttgctctggtccggctggacatccgcgattacgcctcgcgtgaactggacactcttgcactggactttgcggagcagatttttcgtgcctttcaagagcggaaaaaagagatgatcctgcgcgtctgttacgatacggagggaaaggggatggagcgcgagccgcagcgcatttttgtggtgcagagacacatgcaggcgctcggtagttttgcggaacggtatgcggatgccattctgaccgtgcagggcgtgtttgtgggaagctggggagagatgcatacctcccggtttctgcgcccggatcagatctgcctgctggcgcagacctggcaggaggcgacgcaccatgcgctgacactctcggtgcgaaagccggtgcatctgcgcatgctggcgggaaataggccggtgcgcggactgggactatacgatgatgccatgtttgccggagccgaccatatggggacgttcggggatgtgccgagggaggcggcagactgggaagaaccgtggtgtgcggcagatgagcaggcttatctgagcggacaggatgaaaatattctgtgcggaggggaggcgctggcgggaataaagctgtccgcggaggcagtcttagaggaacttcaaaagatgcaggtgacctatttaaacagcatctatgacccggcgcggatggcagagtggaaggcatgccgtctcccgtccggaaaatcgctgtatgaggagatcggcagccgcctcggttaccggatctgcgtgctttgtgcagagtggaaaaagggaagcctttgggtgacactgaaaaatgaaggattttccgccgtatgccagaaaacggatctgcttctgatccgggagtgtgatgaaggcaaagagcagaaggtgcagaaggttccttatgagatctgcggattaaagggcggtcagacggacgtggcaaaggttgaaattgcggcgggagaagacgacggggaaggaaaagaggagaaactctacctttccatggtgcggaagaaagacggaaaaccgctgccgtttgcgaatgaaggcgcgggaagccggctcttgatcggcagatggatggtgcagggaggattgcatggaagagaaaaaggaaacacagattgattttgtgattgcctgggttgacggcggggatccggcatggcagagagagcgggatcgatatgggaagatgggggagaaaacagcggtagaagagaccggagagagagagaagtccggcgttgcctgcgataccagggatgtgcgctaccgtgattgggactgcctgcggttctggttccgcagtgtggaacagaatgccccgtgggtgcacaagatctattttgtcacatggggacatgtgccgaagtggctgaatgggaatcatccgaagcttgagattgtgcgccacgaggattatattccgggagaatttctgccgacgtttaattcccacacaatcgagctcaattttcaccgcatccccggattgtcggaacagtttgtctattttaacgacgatatgtttctgttgcggcaggtaagccccggacagtttttccgggacggaaagccgcttgacatgcttgccttacagccggtcgtggcaaaccgggaggatgccgtcatgccgtatatctatctgaacaatgcgatggtgcttgcgaggtattttgacaagcgggaaaacatgaagcagcagccgggagcctactggcatccggggtatccgctcttatatttcgggtataacctgctcgagcgcatgttcccgcggtttaccggattttatacggtgcacggtccgtcgccgcttctaaagaacacctacgaggcgctctggcagcgggagggagcgcttttgtcggaggtgtgcagccacagattccgcagcagggaggatgtgagtcagtatctgctcagagaatggcagaagctggagggtaatttttatcctgtcaatgcctgccggttctgcaggtattatgatctctcggatcagaatacatcgctgcttcatgtgattgagaagaaaaaaagcccggctgtctgcatcaatgattcccagaaggtggaggcgtatgacagggtcaagagggaattaaacgaagcatttttaaaagcttttccgaaaaagagttcctttgaaacggacggagcaggggaaaagcactaagacagagaggagacgccatggaaacaaagagcagaacagaatattcggcaatgaatacaaccgtggcggtcatctccagaatgacggcgattctgatgggatttgtgacgcgtgtgatttttacgcatacgctgagtgaaaactatgtcggaatcaacggtctgttcaccgatattttaaacgtgctttcgttgaccgagcttggcgcaggcacggcaatcacttacgccttgtaccggccgatcgcggagggcaacatcaagaagcagcagcagctgatgaagctttaccagacattttaccgtggaaccgcggtgtgtgtgggcgtgctgggactggcgctgattccgtttatggacgtgctcatgaaaaacagacccgaggtggagcatctgacgtttatttaccttctctatctcgccaactctgtgctgtcgtatctgctggtgtacaagaggacgctgattgaggcgcatcagatgaattatgtggtgctcatctatcagaccggctttttggtgctgcaggatctgctgcagattgttgtgctgcttactacgggaaactttattctgtttttgttgatgtatctgatgtgcacggttctgtcaaatgtgtgtatctcgcgaaaggcggaaaagcttttcccgtatttaaaggaaaaagagaaggaacgtcttccagcagaggagcggacgggactgtttcggaatatccgcgccatgatgatgcacaagcttgggacggtcgttgtaaataataccgataatttactgatctccgcgtttgtcggcgtggtcagtgtcggaatatattccaattattatcttctgatcggttccgtccgccaggtgttggaccaggtctttgcgggaattacagcgagtgtgggcaatctgggagcaacggaggaccagggcaaaatccgcgagatttttgagacggccttttttatcgggcagtggctttacgggtttgcggcgatctgcctgtacgaattgctcaatccgtttgtggagctggcttttggcagacagtatctgtttgaacgctccgttgtcatgatcttatgcctcaacttttttatcaacggaaccaggaaagcggtgctgacctttcgggattccatgggattgttctggttcgatcgctacaaggcgctggcggaggcggcgctcaatctggtgctgtcgattcttctggtaagacagtatcagacgctcggcgtatttatcggaacgtttttgtcaacgattctcacgtcggtgtgggtggagccgtttgtcctgtaccgaagaagattgcacctgccggtgcaccggttttatttgcgctaccttttatacgcggtctgtgtgggagcggtatggattgtgacagacctggtctgcggactggcagagggaagtccgcttaccgttcttctcatccggctgccgctctgcgtggtgctgcccaatctgttgttttttatggcatacggcaggacgaaagaatggaaacgggtgttggagcgcctgcggcgcatcgagtggggcaggctgcatcggggaggaatgtgatgagacagcagatggaagaagaacaatgggatttgtgcaggctgctggatgcggcgctgcacggcagaccggcggaaatgctcccgccggctgaaaaatacggagccattcttgaactggcagaccggcatcgcgtgctgccgctgctgtacgacgtgctggcacccaagctgcccgaggaggatgagaaccggaagcgccttgagaagagaagcgcagagacggtgcggcagagctaccgcttgctgttcctcgggaaatatgtgacaggacttttgcgggaacatggaatcgagacggttcttttaaaggggagcggcacggcgggactctatccggtgccggaacttcgcaagtccggggatattgatctgctcgttgcggatcagaaagcgggagaaaaggcgtatgaggtgctgcatgagcatggattccggaaagccccagagcagcacgcgcaccatcatatcgtctgcgttggcacagagcagatcggaatagaaattcacgttgcgctggcagagccgttcgactccaaaagcgtcaacgagtggctcgccgcacatcaggcggaatttctggcgcactgtgagaggacggcggtgatgggcgtagagtttccggtgctgcagccggcatatcatgcgttttacctgctgcttcatatgctgcagcatttcctgcgtgccggattcgggttaaagctgctctgcgactgggtcgtattctgggaaaagggatacggcagcggggtagaggagcgttttttctccatggcagaggaatgccgcgtgatgggatttgcgcggctggtgacggcggtctgtgtaaaatatctgggactttccggggaaaaagtgcccctgctgctttgcagatttgactgggaggcggaagctgcaaatctggaagcattcctgacagagattctggaagcggaggagttcggcaagtcaagtgccgaccgtatggtggcgctgcggggaaccggctggcgggattattgccgggaatttcatcatcagatgttgctcacctatccaggggcagggcgctaccgcattctgcatccggtgttgtgggtgatgatgttctgcggttttgcataccgcaacgttaagatgcgccgggtatcggggtacgcggtgttaaagaaggcgagagcgcgcggaaagcttgtggaggagatgaagctgttccgctagaaaataggatgttcgacgggaaaggaggagagcaaaatggatacatggtactgggcactggaatatgtcagggtattttttgcctatgtgatgattctgtttgtgtggccgtctgtggtattccgggattatttaagaggcaggagccgtacggtgcggtttgctttctgtgtgacggttccggttgtgctgctcaatacggtggtactaagtctgggcgtgtttcatatactgtacggatggctgattgccgtgctgttttacggcacattgctgcttggcttgctgagatggcaccccgtgcggcgggagcagatcaaaaagatctcccgcctgtttctgggaacctacggcatccggcttttgctgcttcgcctgcgcaacagggtaaaaaacgggattgggcgtgcacatgcacaattcaggcggagcatacggggacggcgctgcgtctatctgatgctgggggtggttgtgtgctttggcatggtgtatttttcctacggggcattccatgattactcctacgggtttggcgatatgtaccgccaccactcgtggatctacgggctgttaaacggtacgcctttttatgagggaatctacccggaagccatgcactgctttatctacgccatgcgcgtgctgttcggggtaaagatttatagcagccagctgtttctggcgggaatccacgtcgcggtttttctggtcagcgcgtatctgctgctgaaggaattatttgcatgggatggaaccgcggtgcttgcactggcgttgttcctgaccgtggatcttttgtgcattgacgagatcttttccatgtcccgtctgcagtggacgctgccgcaggagttcggactgtatacacaattcctgtgcgcactgtttctgcttcgctgccttaagacggactttagcgacagatccggcagccggagagagcggatcagaaagtttttgacggatgagaatctgctgctgtttctgctgtcactggcggcttcccttgccattcatttttatgtcacgatgatggcgtttttcctctgcgtggtgattgccgcgtgcaggcttcccgctctttttcaaaagagaaggtttgtatctctcgtaaaggcggtctgcctcggtgtgctgatagcggtgctgccgatgggaattgcgtatgcgaagggtgtaccgttccagggatcgatcggatgggcggtcaatgtcataaacggtacggataccgcggaggggcgtaccagccaggcggaacagatcttagaacaggcgcagacatcgagtgagcagacatcgaaggagcagacatggtccggtgagaggatgacagagagcggggagacgacagaagcagcggtgcagccgacggaacaatcccacggggggaacgggcagacaccggatggcgggagtgcggatgcgggacaaaatagcgctccgaaacaatctgccggtaatcatatgcttgcgatggcagaacggatggcggcatcgttcgccggcaaggcacaactggtctggaaatacgggtatgtgcagctgtaccgtgagaaccgggcggaatggattgtgctttttagcggtctggcactgatcctctgggcggtgtaccggatggcggcggggattatcaccggcctgctaaaaaagggaagtgacagcaaaaagatccggcagctgtttgacggatatccggtgctggtcggaatatcggtattgcttatgattgtctatgcggcgccgttcctcgggctgccggagcttattgcaggctccaggctatgctctacggaacagcttttcattctggcggtcgtggtcattccggtggatctggctgccggggcaatcgcccttacgcccggcagacgtgtgctgccgcttgcgcttgccgcgggagtggcggtgatctatgtggggacgagacagcgtggcatttttcacggatacctctactatgaactgaccagatacaatgcggcggtgatggtgacacaggacatcacggataaattcccggagaacagctatacgattgtgtctaccacggacgaactttaccaggtgatcgaacaggggcggcatgaggagcttttgactttcctgaaccgggtgaacggaagtggctataccctgccgacggaatacatttttgtgtatgtggagaagcggccgatccaatacgcgcagaaccacttctttaccggaccggactggctggcagaggaaaaatacacttcttactatacgacctatttcagcgaggggaacagcatcaatgcctcggagatctcgcgggagcaggcagagagggagatgatgacattctcaaaactctcgcagacctattccaatctggacagccgcacgatactggaatccaaagcgtacgaatggtgcaggaagtttgaagcatcctatccgcaggagatgaaggtatattatgaagatgagaatttctgctgctatatgatacggcagaacacctatcggttatatcagctggaggaatcatgagtggacgttggaaaaggattttggcgcttggcgcagcggttgttttgtgtcttatagcagcagctcaaatgggcagtctgtttcactggaaggtgacatgtacgccggcggcgtttgcagagtcatccaggaggctttccaatccggaccgcggattttattacatttacggctaccgcattacggatgaaccggtcgactatgccacagatttaagagacaggacgagggaagatgacgcgacgcggcttggaatgatgcagatcaatctgcgggaataccggacgggtgccatatcggaggaggggctgtcaaatgtccggcagttgtttgcagccatggcggacagcgacaagaaatggatcgtccgtttcctctatgactggaacggggagaacgagcagtatgaaccggagaatcttgacattatattgcagcatatggagcaggtgggagatgtgctccgggagtatcacagctgtatctatacgcttcagggactctttatcggcaactggggggagatgaacggaacaaaatacacggatccggattctatgagagaactggcggcacgccttgccgatgtgagcgatgcgtccacgtttctctccgtgcggacgccggcgcagtggagaaaaatcacgggggaggcggcaccggacggctggacagagaacccgctggccaaaaggcttggactttttaatgacggcatgctgggaagcgtgagcgattacggaacttacagcgataacaccagacaggacgccggggatttttcggcgtggacgcgggaggaagaactggcatttcaggatgtattgtgcagcagtgtgccgtccggcggggaagtgattgtcgataacccgtacaatgatcttgaaaatgcgatcgcggatctgaaaaccatgcatgtgagttacttaaacgaggactatgacaggaatgtcctggataagtgggcagggacggtcgtgaatacagatgactgctacgacggaatggacggctggtcttatgtggaacggcatctggggtaccgcctgtggattgccggtgccgctttgagccattcgttctgggcggatacggtggaggtaaatgctgctttaaaaaacagcgggtttgcaccgttttaccggcagacaaaagtctgtgtgagcgttacagatgagacgggggcagtctgctatacggatgaatgggaagaggagctacttaagctttccggcggaaatgaggacgacagggaactggcgctcaccggaaccattccgatccgcggctgggagagcgggacttaccgggtatatatcaatcttagcgatgcagacagcggggaacagattttacttgcaaacgaagcggatgccacagaaaacggatactgcctcggtgaggtggcagtgcgataggtgcacaacgatgcaagtacaaaggcttacaagtgcaaaatcgtacaagaaatcacaagtttgtacgaggaatcacgccgcagaaaccactataatgaaaagaaaaagaatcctgtatgtggtgggattgtggaaggtggtttcttatgcagaactatgaaaaaccggaagtgattttgatgacggaatgttcggagggcgtctatctggcaagcggcggacagaccggggaagatccgacggcaggtggatgtgacagccggtacatgaagggagcctggaaaaagccggattacagcaacagcaatgtgcagatgcgtgcctatgacagaaaaggctgcgagggctgtgcggcggatgacggtgacggctgcaagctgcaaaagggtgatgcaaaagtcgccggaaatgtctatcagcctgtctgggaacagcagggactgacaccggatgccatggtctggtagagaaaatgccggcatgccgttctggcagaaaattcatgcttgacagcgtaaacacagaattttatacttaaaatatgtgtatgagtcagcggcagaagtgccgcaaaaaagtgttagaaggtggctggttttatgaagaattatgagcgtccggtgatgatacggacggaggagcttgcagagggggtttatcttgcaagcggaggcatcaagtgtgacagtgtctacatgaacggtgtgtggcaggcgccggattattccgactggaatggcaccacacgcggatacaagcagcagttcggatgtcttggatgcccggcgaatactgcttccggctgcggtctgttgagccattatgtggattccgggtatgcgggaagttacgatgtggataatggtaaccgtaagccgtcatgggagaagaagggctatggtccggatgatgcggtcacagactggaacatgtaacaatctttaaaacgggggaaatgctatgacgaattatgagagtcctgtgattcttagaacagaagagcttgcggaaggggtctatcttgcaagcggatgctatacggcgagtgcgtacattcatcagacaccgcagtccggaagcggggagtaccgtatccaggtgaacggtcagcacagtgccgatcatacgaaagaggcgcagacactgaccatttcgttcagtcttccggtaacctacaccagttccggcggatcactggtatccggcagcggaacgaatacacttgtgatcaattataactatcatcagaatccgaccgacaatatcggactcggggatctggttgtgcaggcagatgcggggcttgcggtgacaagcgtgaacattacagattaagaagccggcaggcgaccgggcggatgtgagaagtcaaaagcttcgcgggaggaatcggttcctcctgtgaagctcttttttatgtaataggaaacttctttcctattacataaaaaactctccagggatcgcactgcggcggagacgaaagatgtcgcaagagcgacccgccgcaggcggagaatcctgcagacagaattcatttttatgaaagaataggaaaattacaatgcttgagaagttcagacattacagagagcggatcaaagagggaatgctccgtgatatgtggagacagacgctatggatctacgaatatgcgagactttattggaagcagatgatattttatacgcttctgggacttgcgggaacgctggtatcgctcatttcaagtctcatttcccgcgatatggtggatattatcacaggacagcaggcggggcttctggcgcgcaccttctgcctctatatcgggttctcggttggaaatgtcctgatttcccagatctccaattactttgcgaacaagatcagcatcagcgtggacaatgccatcaaggcggatatttttgaaaaaatgctgttgacggatctggagtcaatccagaactaccacacgggagatcttttaacgcgctggagttcggatgcctccaatatttcaagcggtgtcctaaactggattccgaatctcgtgatctatacggtgcgttttgtcagcacctttgcggtcgtgttctaccatgatccgatgttcgcgttattagcgctgatcggaatgccggtcagcatgctgatgtcgaagacgctgcttcgccgcatgaaggggaataatgagcggagtgcggcgatgagcgcaaagatgtcgggctttaatcaggaggcgttttccaatatccagacgatcaaggcatttgatctgatccggctgtacgcggagcgtctgcgcggtctgcagcgggagtatctcaccatgaagctggagtttcagaaaatgtctatggcgacctcaattctgctgtcgatcgtgggacttgcggtgtcttacagctgctacgggtttggaatctaccgtgtgtggagcggtgcgatctcctacggtaccatgaccatgtttttatcgctgtcgggctctctcacgggaaccttaaaccagctggtgtctctggtgcccacggcagtgtctttaaccacatcggcgggaagactgatggacattctcgatatgcccaaggaagatttttcggatgccgatcaggtggagcagttcgccggacagaatcggtcggatggcatcggaatcgtcttttccggggtgagttacgcctatcataatggaaagcaggtgttttgcggtgcagactttttggcgcgtcccaaggagattgtcgctctcgtgggaccttccggggaggggaagacgacaatgctccgcctgatgctggggcttttgcatccgcaggagggagagcggatcctgatcggggagacggacggggagaagatcgccgtagatccctctgcaagacggctgttttcctatgtgccgcaggggaataccatgttttcgggaacaatcgcggaaaatatgagaaatgtaagaccggaagcctcggatgaggaaatctgtgaagtgttaaaggcggcatgtgcctgggagtttgtggaaaaacttcccgatgggatctattccatggttggagagcgtggaggcggattctcggagggacaggcgcagcgtctgtcgattgccagagcactgcttcgccgatcaccgattcttctgctggatgaggcgacctcggcgttagacgtcgtaacggagcgcagagtgctgcggaatatcatgagcaccacggagccacgcacctgtatcgtcacaacacaccgcccgacggtattgtccatctgtcagaaggtgtaccgcatccgggagcagaagtgtgtgcagatgcaggaggaagagatccgtcagatgatgcgggaattctaaagagcatcgatggcggcttttaaggtcctggcagcggaaggctctttcgtgcagtacagccggcaggaaaagatgagcggagcgagggcttcggaaaaatgcagattgcgaaggagaagctcctttgtccacgcgggggagatcatccgctgcaggatgtggagcactttttcgtccggctgcagggactgcacctgatctatggcagcctgctttaagaagatgatgccgccgagcggatagtctttcggggtgcagatgcccgatgtgccgcaccatggaagtccataggcgtagggtatgttgtctctgattccgagcaggtttaagtcgccgtttaagaggggcgtctggtacagatcatgccacagggcagagtgtgtggacttcccggttccggaactgccggaaacgagaaaggcgcgcccgcggtacaaaaaagaggcggagtgcagcacataaagctccttctgctgagccaggatgagaaaagcgaagcgaagtgcgtgaaacaggtcttcgatgtgcatatcatccggatccggcatgcggtaaaggacggcgcgcgagccgtctttttttacatgcatttcgcggatgccccacggcgctgcaaaaaagaaacaatacgaacttccgctgtcgcagatggtaagttcctccgtgtgaataagcacggcgccgtaaggaatggaagccggtttcccggtcagaataagaacctcctggtcgaagtcttcctcttcgcaggaaaaagcggagaagaagcggtcgtataggagagagggaccgcggtaggaaaagaccagaggaccgatgcggtagaaaagaggaggcgtatcatcgccccggctttcgggtgtatccgcaagaagaattcccatacggcacagggaatgaagatactggtcgacatcttccgcaagtgccgcgcgctcgcgctctgtggcatggtaacggtctgcgagaagggcgagcagttcctcgcggctatcgccctctaagatgccgtcccacagaagtgccccggaatcgttgagccgggtggcaggagcgggagctgcgatgagctgtccgtaaggaagcagatagggaatacctgcgagcgttgccttgatgtatcgatcgttgagtttcataccggtgtcactcctttattagcggttcataagtatgcttattatagcattcagaggtaaaaaatgctacaatgaatgaagagaaacgggaggggaagaatggagcagatctatgagattgagccgctccttaaggcgggagtatgcatacagattcatccacaggggtacagcatgtatccgtttatagatccgcggagggacgaggtggtacttgccggcatagaggatgggagcgcgctgcggcgcggggacgttgtgctttatcgcagggaaaacggaatgctggtactgcaccggatttataagatcgggcaggacggactgtatctgctgggggatcaccagacagccatcgagggacccgtgcggcgggagcaggtcaaggggaaaatgaccggtatggtaagagacggacgctatatggatgtggggaatccgggataccggatgttaagtgtggtgtggctatggctcagaccggcgcgcagagctattatggtgcctgccgcgcggctgcggcgcatggtaagattcgcacttttcagaagaaacaataagcgctataataaatagagggatcaaaaagcctgggggtgattacatgatgaagattttatttgcagcttcggaagcagtgccgtttatgaaaacgggtggtctggcggatgtgaccggatcgctgccggggtatttcgataagaagcattttgatgtgcgcattatcatgccaaagtatttatgcatggatgaaaagtggaaggcacagctgcggtttgtctgccatttctatgtgaatctcagctggcggagacagtacgtcggtatctttgaaacggtacagaacggcattacatactattttgtggacaatgaattctactttgcgggagataagccgtatcacaatatctatgaggacgtggagaagttcgcattcttctcgaaagcggtgttagaggcgctgccgtatctggatttctggccggatgtcattcactgccatgactggcagacgggactggtaccggtattcttgcggacattttacggggatcagagatgttattccaatatccgcacggtcttttccgttcacaatctgaagtttcagggaaggttctcactgccggcggttatagatattaccggtctgccagagcagatcttttcttcggataagctggagtcctacggggaggccaactacctgaagggcggtgtggtgtatgccgatgcggtcacgacggtgagccccacatatgcgagagagatcatgacgccggagggcggagagggattggacggtctgatgcgcgcccgggaaggcagcctgtatggaatcttaaacggcattgatatcagggaatatgatccgcagacagatgcctatctggcgaaccattacaacgagaccaatcacacggaggggaagggactcaataagttaaagcttcagaagcttttgggactcccggtggataaggacgtatttttacttggaatggtgtcccggatgacggatcagaagggatttgacctgattgcctatgtgatggatgaactgatgagcaccgagcgtctgcagcttgtggtggcgggtaccggtgaggcgcgctacgaggagatgctgcgctattttgcggaaaaatatccgcagaagattcacgtgacgatcggctactcggaggagcttgcacaccgcatctacggctcctgcgatgcgtttttaatgccgtcgctgtttgagccgtgtggtctgtcgcagctgatgagtcttcgctacggaaccgtgccgatcgtgcgcgagacgggcgggctgaaagatacggtgatgccgtacaatgaatacgagcagaccggcacaggattctcctttgccaattataatgcgcatgaaatgctgggcgtcctccgctatgcgatgcgcgtgtattacacgcagagaaaatgctggaacggcattgcggagcgtgcgatgcgggaggatttctcctggaaaaagtcagcggagatgtatgcgcggctgtatgaggatatcgtgggcagaccataggatcacatagtgatctggtccgtctcgagggagtagtagtagacgtgatccgacaaaatctcttctctggccagctgggacgaattgacgtcccggaccatggaggagagtgtggacatactgatctggttgtctgcgggaatcagaagaacttcgtggacgctgctcggcagaatataaaaatcactgccgatgcgccgggcaaaatcgtgcagcagatgctgatagagaatacaggaggagccgttgagcctgtgctggttggacagaacgtagatcggaaaaggctcaatgagatcgtttcccgctggatccgcaaattcatccgcaaacagctcgcgcagaacttcggtcatgctgcgcagatcatagcggagcagctgcggtgtgtttgccatggcgagggcgtagaggtcgtctctggtaatcccccagtaagtgagatgttcattgtggatcaggaccgttgctgtgccggaagaatcagattccaccaggcataagaagacgatggcgagatccaaaaagcgatagtagggaacccgctttaacagttcgcggttgcgctcatagttgatcagcttcattgtgacgcgggattttaccttgtcatagtcggtgaaaaaagagatgtcaacaggggatttgggacggttctcccgataggcggtcagaatgtcgtctgtgatgtcggaaaacgatctgccgcgctcatactgtccatagtagtaatccagataaatggtgggcgccaggttctgaccgggcgcgagaatggtgagtccgtcaagatgggtatcgttgtttttgagaatgtctgaaacagtgatgcggacatcggagccgaggcggtccgagagagtagagatgatctgctgcttgaaatcgtggtaattcataaaatcctccgaatgaatggaggggaagtaaaatcgtacagatggggaagaaaaatccacatgaatgcgtagctgcatttatgtggatttaatttatcatatagaaagtcaaaaagcaattggacaatattactaaaaatgtcggatgctattcggactttaatgttttccagagatagctgtaaagctctggggtatcgctgccgagctgtttgtagaccgtgcagttcgcaaagacatcgtcaggaggaaagatcgtggtatcattgcgggtgtcctcgtcaagcgcatcgacgacggcctgatttggcgtggcgtagcagacgcagtcaaaattgagcatggcgacgtcctcgcggtacagaaaatccagaaacttttcggcgttttccttgtgtgtgctgtcagccggaatgaaccaggaatcgatccagaggttggatccctccttcggaaccgtgtaggagagatcggcgttggactccatggcggtggctgcctcgccggagtagacgagcgctaacgccgcattccccgcgatcatctcatctgcggtctcatccacataataagcgtagacgaggggtttctgctccaccagaagcgagagcgcgtcacgcagatcggtctcgtcctccgtgttgatgtcgcggcccagaagacggagcgccgggacaaaggaatcccggacggagttctgcatgatgatggtatcgcggtagcggtcgtcccacaggatgttccagctctcggtctcctcctcgctcaccatggtcgtgttgtacaggattcccagcgtgccgtaaaagtacggcatggaatactggttctgcgggtcgaagacctcggcggcagcaagaatagcgggatcaagattcttatagtaggagaaggaggaaaaatcaatcggcgccacttttccctcgtggatcagccgctccaccatataatccgaggtgcacacgacatcgtaactgatggaaccggcagaaaacttcgtgtacatctcctcgggactctcgtattcctcgagcttgatcttgatgccggtttcctgctcaaacattttgatggcggaggcatccagatatttgccgtagtttaacacgacgagggaattgtcgccggagctgccggcggtatcggtatccgcgctgccgcacgccgagagaagcagggcggcaaacgcggcggtaatcagtgcataatggaatcgtttcataagtaagtggcacctcctttaatggataccggcatgattcccggcgattctgtccgaacggcggttcatgacaagaagcagaagaaatgcaaacaaaatggttgacagggcgtacaattccgggcacacccccttgcgcagctctgtgtagagcatcgtcgacagggtgttgacgccggcacctttggtaaaaaaggcgatggaaaaatcgtcgagcgacatggtaaccgccatcaggaatccggaaaatacaccggatttgatctccggccaggtcaccttgtagaacgcgtacatcggagtggcaccgagcatgatggtgcggttctttttttttcatggcactgatgccgatcgcggcaagcgttccgatgacggtcgagacgatggctgcggtgagtgtgacctgtagagttgtcacaaacgcattcatgatggtctcgtccgtaaaacaggaagcgtaccatttgagtgtaaaaccgccccatacgacacgtgattttgaattgttaaaagagagcacgatgagtacgaggatcggtagatacaaaaataaaaagatgacggcaagatagatgcgctgtccccatttctttaccataccgcggtacctccttcgtctttatccagcacattcataagtgccatacttgcaatgacaaacagcatcagcacaacggacagtccggaacccagatgccagttggtgccctgcataaattcctgctcaatgacgtttccgattaagagcaccttgcccccaccgagcaggtcggagatgacgaacgaggtcagtgccggcacaaagaccatgacgattccgcttaacacgccggagagggtgagcggaaaaatgatttttacgagaacggtcagattgttcgcgccgagatccctggcggcttcgatgacgtccttgttgatccgcaccatggagttgtagatcggcaggatcataaaaggaagaaaatcgtacaccatgccgaacacaacggcggtcggggtgttgagcatcttcacatggccggtgccgacggcttctaaaatggcattgacaataccgttgttggagagcagaagtctccacgcgagaatgcgcagcataaaattcatccacatcgggaggatgaacaaaaagacgacaaagctctggtgacggaagcggaatgtgcttaaaatcatgcagagcggataggacaaaacaaggcagaacagcgtgcacagaaagccgagctttaaagagagaagaatcgacttgacatgcaccggatcggcgatggcggcgatattggaaaaggtaaagctgccgtccgccgcagtgatggcataatagagaataaatacaagcggcagaagaataaatccgatcatccagatcagataaggtcctgccagaagctgttttttgaagttagacatcgattcctgctgcctcctcgtcctcggattccggtttgttcataatctggatgttgaatggaatcacgcggatcccgacatgggttccgacggtgtaaaactgcgtggtgtccaccagccactcaaagccgcccgccatgatctcgatctcgtagtggacgcccttgaagatgacggaagtgatatcgccgtccataaagccttccccgggtgcgacgatctccacattctccggacggatgacgacgtcgaccggcgtgttggtgccgaatccttcatccacacagggaatcctggtgccgagaatctcaacgacccggtctttcatcatgataccgtcgatgatattgctgtccccgataaaatcggctacgaacgcgttgaccggctcattgtagatcatttccggtgtgccgatctgctggatgtagccctggttcatgacgacgatggtgtcggacatggtgagggcttcctcctggtcgtgcgtaacaaagacaaaggtgatgccgagctcgtttttcaggcggatcagctcatactgcatttcctggcggaactttaagtccagtgcgccgagcgactcgtcgaggagaagaaccttcggctcattgacgatggcgcgggcgatggcaattctctgctgctgtccgccgctcaaagaatcgatggagcggtgctcgaatccgtccaggtttacgagctttaaggcgtatttgattttgtcgtcgatgtatgccttgcttttttttctgatcttaagtccgaaagcgatattttccgcgatggacatatgcggaaaaagggcgtatttctggaatacagtattgagatcgcgctcattgggcgggagggcggtaatatcctttccgtcaaacagaacctggcctttgtcaggggtctcaaatccgccgataatgcgcagggttgttgtcttgccgcagccggacggaccgagcagtgtgatgaattcattctcacggatgtagaggttcaaatcgtccagaatgacattgtcaccgtaggatttggcaatgtgcataagattgatcagttttttgctcattcgggggagtcctttcttaatatatgcagaatgcacccgcatgtctgcgggagatcgatgatatgctgattttgcagtattttcatagcataagaaagattttattttaataattgaaaaaaagtagttgcaattttttgaaattccgttataataactcaatgtgatgttaaacatgacctgccgatatggctcagttggtagagcaacgcattcgtaatgcgtaggtcgtcggttcgagtccgactatcggctttaaataaaaactctcagtaattgtgctgggagatttttatttatatgctagttataacacatgcttatcaatgtttattagagcgggttatgactgagtgcaaaaggaggaaaatattatgaagaaaaaagtgattagcttactgctcactgcagcaatggcaaccaccatgttcgcaggctgtggttcttccagcgaggagaatacaactgcagacaacaatcagacagcagcaccggcagcgacagaggctgcagcagaggagagcacagaggcagctgctcctgcagtatccgctgatggaaagatcgcaatgattaccgattccggtgacatcacagacgagtctttcaaccagatcacatgggagacctgtgtggcttacggtgataagaacggtattgagtatcagtactataagccggctgaggacacagacgaggagagaatcaacgcaatcgaccttgcagttgcagacggtgcaaccgtaatcgttatgccgggttatctgttcggaccggcaatcgctgaggagcaggatctttatccggatgtttcctttatcgcagttgatgtgacagaggctgacatcgtagatctttccggcaacgcagtcggaatcagcgacaacgtatatatctgttctttccaggaggagcaggcaggttaccttgcaggttatgcggcagttaaggatggttacacaagccttggattcctcggtggaatcgcagttccggcagttatccgttatggttacggttatattcagggtatcaacgatgcagcagaagagatgggcgttgatgtagatgtgaaatactactatggcggtcagttctacggaagtgatgcgatcacagctcgtatggagggctggtatcaggatggcacacaggttgtattcgcatgcggcggcggtatctacacatctgctgttgaggctgcagagcagtacgacggcaaggtaatcggtgtcgatgttgaccagcgtccgaagatcggtgatctgtgcattacctctgctatgaagggcttaggctctgcagtgaactctgcactggatgcatactttggcggcaactgggcttccatcggtggcaagtctgagcagctcggtctggcacagggcgattatcttggtcttccgacggatacagattcctggggctttacaacatttacggtagatgagtacaatacagtattagacggactcaaggacggcagcatcactgtttctaacgatacagagaatcagccggaggtaggttctcacgtgaccgttgactatgtagagtaagcggactctttaaaggggaagagaaatagtttctcttcctcttttttttatatccagaagatgttatactataagatatgcaggaatgactcatgcggcgcatgaaaaaaaagaacgaagaggatacatgtatatggaaaacgaatatgttattgagatgttgaacatcacgaaagaatttccaggaatcaaagccaacgataatattaccctgcagttgagaaagggagagattcatgcactgcttggtgagaatggtgcagggaagtctacccttatgagtattctgtttggtctgtaccagccgacgtccggtacgatcaaaaagaacgggcaggttgtacagatcaatacgccgaacgacgcgaatgatctgaacatcggaatggttcatcagcatttcaagctggtggagtgtttctccgtgctggataatattatccttggtgttgagccatcgaaaggattgttccttgaaaaagatggtgccagaaaaaaggtactggagctgagtgagaggtacgggcttaaggtggagccggatgcgctgatttcggatatcaccgtaggtatgcagcagcgtgttgagattcttaagatgctctaccgtgataacgaggtgctgatctttgatgagccgacggcagtgctgacgccgcaggagatcgaggaactgatgaagattatgaagaatctcgcgcacgagggcaaatccattctgttcatcacgcataagctgaatgagatcatggaggtggcggaccgctgtacgatcttaagaaaaggaaagtacatcggaacggtcgacatcgcggatacgacgaaggaagaactttccaagatgatggtgggcagaaatgtaagctttaccgttgacaaggacgagaaaaagccgggggatacggtgcttgaggtatcgcatctgacggtggcaagcagatcacatgagaacaatgccgtgcgggatgtctcgtttcaggtgcgccgtggtgagatcgtatgtattgcgggtatcgacggcaacggacagacagagttggtgcaggggctgaccggactggagaagatcggagggggcagcgtgaaatttctgggacaggatatcacaaacaccacgatccgggagcgttccaagcatggtatgagccatattccggaagaccggcataagcacggactggtactggactacacgctggagcagaatctcgtgctgcagcgctactggcagccgcagtttgaacgcgcgggctttatcaagtcgggcgaggtgcgcagatatgcgcagaagctgatcgagcagtatgatgtgcgaagcggtcagggacctgtgaccattgtgcggagtatgtccggcggtaaccagcagaaggcgattattgcaagagagattgacaaagacccggagcttcttgtggcagtgcagccgaccagaggtcttgacgtaggcgcgatcgagtatatccataagcagcttgtggcacagcgcgacaaaggaaaagccgtgctgttagtctcgttggagctggatgaagttatggacgtgtccgaccgtatcctggtgatgtacgagggtgagatcgtaggagaactggatccgaagaaagtgactgtggaggaacttggactttacatggcaggtgcaaagcgggatgaggttgcaaagaaagcataaaggcgaggccttacagattaacagaaaggaaatatgacaatgagtgaaaagacaaaggatgtcctattgtccatctttgcatcgcttctttgcattgtgatcggacttctcgtgggacttatcatactttattgtatcaatgcagagaatgcattggatggtttttcaagaattatcaagggtggcttttacctcaaaccaaagggaatcggaagtgagattgcgcaggcgacaccgctgatcatgacgggtctttccgttgcgtttgcttttaagacgggactgttcaacatcggtgcggcaggccagtataccttgggcgtgttcggtgcattgtattttgcactgattctgcagatgccgtggtatgtatgtcttctggcagcaatggtctgcggagccatctggggtgctgttccgggaattttcaaggcgtactttaatgtcaatgaggttatcacctccatcatgtttaactggatcggtttatatctggtgaacgagctgatgtacagcacggtatccggaatgtacgaccagaagacgacgcgtacttacaagctgagttccgcagcaccgcagtcattgattccagattgcggcatgagcgctgtttttaagacaagctcgaccacgattgccatttttatcgcgatggcgatcgcaattatcatgtatgtggtactcaataagaccacattcggttatgagttaaaagcctgtggctttaacaaagacgccgcaaaatatgcgggcatcaatgaaaaacgcaacattgtgctttccatgacaatctccggcgcacttgcaggtatcggtgcgggactttactatctgtccggtgcatccgagtggaatccgcaggtgtccacagcgcttccggcgatcggtttcaacggtatcccggtagcacttttggcgctgagcaatccgatcggcgtggtatttgcagcaatctttgtcgcacatatctccgtgggaggcgcgtatctaccaaccaagtattatcagccggagattgcggatctgatcgtggcagtcatcatttacctgtgtgcgtttgttatgctctttaagagcgtggtcgtatcgaagctcagcaggaaaaaagcgaagaaggaggatgtgaaataatgttcttactgattaagtttacattactctatgcggtagtattgatgctggtggcgcttggcggtatgttctcggagcgaagcggtgtaatcaacattgcacttgaaggtatcatggcaatcggcggtctggcgggcgttttcgtcctggcactctgcggggattcccttccgtccggcgtgctggtggcggtgtccatcctggcaagtgcggtagcgggaattctctattcccttctgctcggattttccgccatcacgttaaaggcggatcagacaatcggcggaacggctttaaatatgcttgccacagcggtggcgatcgtagcggtaaaagcgttcaacaactcctcggcagcgggaaacggtgcggcttccgcaaagctttcctacagcaacaaggcatttatctataaaatcggaccgctcacgatcaacattttcctgattatcggaattatcattctgattgtaagctatgtatttttgttcaagaccaaatggggcttacgtctgcgcgcgtgcggtgaacatccgcaggcagccgattcggtcggtatcaatgtgtatcagtggagatataccggtgtcatgatctcgggtgcactcggcggaatcggaggcttcgcctacatcgttccatccgttaccacctggaactttgaggtcggcgtagcgggagccggtttcctcgccttggcagttatgattttcggacagtggaagccgttcaacattgcgggcgcagccgtgttctttgcggtattccgttccctggcgaacatcgcggattccaccgtgcttgcaaacctcggattgtccaagaatatctacagcatgatgccgtttatcgcatccatgattattcttgcgtttacatccaagaattcccaggcaccgaaagcggagggtattccgtatgataagggtgccagataggaagacggcgtaagagaccggaatttccggaagcgtccgggagcatatgataacaaacagaaaggattctaagatcatgatttcaagcaaatattttgaccatactattttaaaggcagaggcgacggagacacaggtggcaaagatctgtgatgaggcgcttgccaatgatttcgcatccgtgtgcgtgaaccagtattacacccgttttgtggcagagaagttaaaaggttctgacgtgaaggtgtgcacagtggtaggtttccctctgggaatgtccgacaccggtgtgaaggcattcgagacgaaggctgccatcgaggacggcgcacaggagatcgatatggtaatcaatgtcggcgcattgaaagacaagaagtatgactatgtaaaaaatgatattcataccttaaaagaagtctgtggcagcgatattgtcttaaaggtcatcatcgagacctgtcttctgacagacgaggaaaaggtgaaggcatgtgagctggcaaaagaagcaggagctgatttcgtaaagacttccaccggattttccaccggaggggcaaaggcggaagatgtcgcactgatgagaaaaaccgtgggcgatgatatgggtgtgaaggcatccggcggaattcacacggcagaggaagcacaggcaatgatcgatgccggagcaagccgccttggaacgagcgctacacttgctatcattgggaaatagtaatcaggagcggtaggatgaatacaattttgattggaattgcaggaggcaccggaagcggcaagacaacacttgccgacaaactgatcgacagctttggcgatgatgaggtgagtattctgcgtcatgataactactataaacgccatgacgacatgtgttatgaggaacggtcgaagttaaactatgatcatccggatgcgtttgatacagcactgttgtgtgaacatatctgtaagctgaaagcgggagagcagatttatatgccagtctatgactactcgatacataatcgttccgaggagaccattctggtaaaacctgcaccggtgattgtgctggagggcattctcatttttgctgagccgagtctctgtgatcttatggatatcaaggtatttgtggatacagatgcggatgtgcggattctgcggcggatcatccgtgatgtaaaggaacgcgggcgttcgttagacagcgtgattacccagtatctgacaacggtaaagccgatgcatgaacagtttgtagaaccgagcaagcgccgggcagatattatcatcccggaagggggagaaaatatcgtggcgcttgacatgctgattgaacgcgtacgcaaacatttaaagaataaataattagcgcaataaagtggcaggcactgtgtctgccatttttttatatgcaggattgctcggatgcagatgatcgccgctgtcatatccttccgcgaaagagcgcggatcatcggcggcacgaagtgcctgatcgaaatcgatacagccgtcgctctcgtggttggagcggatccagtcattgacggcaccgcgcagctcttcgcggaacggtgcgtaggtgcgccagccgtaaatcggcagaagggttccgagatagacgctgtcgtgaagctttctggcctcctcgatataccatttcagaccgtcgatcagttcggcggcagtcggcagatcactcatgggacggaacggattgacgtcggttccgaccggatggatgatgtcattgatgccctgctggatgatgacggtatccgcaccggcggttggaatttcgtgggcaaaacggttggttcccttaagaccgtaggaatcgtaggtgatacagtcgtactggcgcagaatacgcgtaccgcttgccgcacggcggatcaccgaggtatggttgtgcccttcttcgatgaggcgcagcgtcagatagtccggccatgcctgtgcggtgatggaatctccgtagcagataatggcatgacaatcttcctttgtcagaatatcgatgttgctaagaaaatagaaccagtttgtcgccttggaggtggcaaggggcagcgcttcgctgtgcgtctggtcgccgtaggaaaaatagccgcgggacaatggacctgtgatcagcacggcggactgcatggcagtgtagccgtcaaaatacaggctgacgcagagcgtctgaccggcagataccggaaaggagagtgcatcgctcgcggcggatgcacccgctgccagtgtgacggaatggctgccgtcaaaggtaatatcgcggatggtgcctgcagcaagcggacaggaaagaggaactttcccggtgagatcggaatcacacaccgccaccgttgcccggtggatggtgacaggttcctttccgcagtagttgtcgagcgtgaagcggagtgcgcttccggaaaaaggtgcatagaccggatagcgcagcgtcagatcttttgcgtagccttccggatgatgttctgcgatggacatggcattgccccacatggagacccattttgtatcattcataagtttgttctcttttctttattatttactggtaaggaatataagagtatattcctgcgttattatagcggaagtgaaggtatttttccagtggacttgttctttttttcgatccttgctataatgagcgcatgcgggtgaagacctgcagacagaatagaaagacaataaaggagttcatttgtatgggagagattgcaaatcgtgataataagaagatgctgattttgtttgcagaggtggttgcggcgcttgcgacgattctgatcgccgttttagcgatgaagattccggtggtgccggtgtgtgtgatcgttttgatcgaggtggcgattgctgcctgtctgcaggaggtaccggtgtgggtacacgccgtggtcgccgcagtacagctggttgccggggtactttgcggcagagccgtattctgcctgttgtgtattttgatctatgtgtttgcgatactgacactgcgggaagcaagagcgtaatgataagacctttatgaagcggatgcttggtaaaggtcttctttctgtcaaaggagaaaagatgttagagaaactttttttggaaatgatcgcatattacagcggagacccgaaacggatccagcattttacaaaggtacacagctatgcaaagctgatcggggagcgcgaacagctttcgccggaggaactctatattctggaagcagctgcatacacgcacgatatcggcatcaagccggcggaggagaagtatggaagcagtgagggaaagctgcaggagcaggaaggccctgcggtggcacgcgggatgctgatgcggctgggctttgcggagaatgtgattgagcgcgtctgctatctgatcggacatcaccacacctacacgggcatagagggcagagactatcagattctggtggaggcggattttctggtgaatttgtatgaggacggcagaacggacggagacggcgggtttgtgccggataaagcggctgtagagacggcatatcagaggatttttgcgacggagaccggaaaatggatctgccggagcatgtttgcacttggaggtgtgtcatgatgcaggaaaggaagcagaagggaaaaattctggtattcagttccagggaaatctgctatctgtccagcaactttttcgcaaatcagatcggcgcggcgtttgaggaactgggatatgaggtgacggtgtgcgaactctcaaaggaggatgatctggatgcgaagcttgcgcgctatatcggacagccgtaccgcctgattctggattttaattcccttctgccgcggatggtgttagacgacggcactccctatgtggaccgcctagcgggaccgttttttgactatattttagatcacccgctgtttcactatcagggactttcaagcggtgtgaaaaacctgcatgcgattgtcctcgacgaggcacagcagaagtacgtagaaaaatattatgaaaaggtggcgagcgttcacatgctgccgctcggggcgacaagagcagtctacgagggcacaaaagagccggagtgccggattttatttccgggaacgtatgacagaccggacgcggtttatcagattgtagagaatgctcccgagccgcttgggagcatgatgaaagatctgattgagcggaggcttgccgatcccacactgccgatggaggaagcattttcacagcagcttaaggaggagaaactggaacttcctgccggacagtttgcgctgtttatgaacagcatgtatgcggtggatgcctatgtgcgtgattatttccgcaaggcggtgttggacgcgctgctcgcggagaaactgccggttaccgtattcggggaaggctgggaaaaatattcctgcggggacgagcacagcctgcggcgcgagccggcggtgccgtttgcgctctcctttgagcggattgccaaagcccatgtgcttttaaatgtctcaccgatttttaaccggggaatgcacgaccgggttcctgccggaatggcgaatcatgcggtggtgttaaccgatgaaaatccgtatttaagaagaacgtttacagacgggaaggagctgcttttttattcgctggaaaaaccggacacgctgtgtgagcaggcggagagaacacttacggatgtaagacttcgtgagaagattgcggcttctgcctatgagacctttgagcgggaatatacatggaagcgccgtgcggagcagatcctcgcatttgcagaggaggtggaagcatgagagcacagaagaattatcagaaaatgctggaggcgacgatcgctggattaaaggagcagaaccgtgtgccaacgctgctgctgcacagctgctgcgcgccgtgcagctcgtactgcctcgagtatctgtcgcagtattttcatatcaccgtggattattacaaccccaatatttatccggaagaagagtatcatatgcgggtgcaggagcagcagcggctgattcgggagcttccggcaaaatatccgatcgcattccgggagggcgcctatgataaggagcgtttttatgagatggcgcgcggaatggaggaggaaaaggagggcggcgaacgctgcttccggtgctatgagctgcgcttgagagaggcggcggagaccgcaaaaagccttggcatggattactttaccacgacgctgtccatcagtccgctcaagaatgcggaaaaattaaatgagatcggggatgcgctggcggaggaatacggcgtggcatatttgaattctgacttcaaaaagaaaaatggctacaagcgctcggtagagctttccgaacaatacggaatgtaccggcagtattattgcgggtgcgttttttccaagcgggagcgcgatgcccagattgctgcaaaagcggcggcacagggaatttgatgcggtaaagcatgaaaggacttgcgggaagcgcgaacttcatgtagaatgataggaaatgtagtgaaagcgaggtttttaaaatggctcagttatggggaggacgttttaccaaacagaccgacaagctggtctataattttaatgcgtctatttcgtttgaccagaaattctataaacaggacattgagggaagtattgcacatgtgcggatgctcgggaaacagggaatcttaaccgaggaggagatgcaggcgatcgtcgcatgcttaaaggaaatccttgcggatgtggaagccggacgtcttgttataacggatgaatatgaggatattcacagctttgtggaggcgaatctgatcgaccgtctgggagacaccggaaagaagctgcataccgggcgcagccgcaacgaccaggtggcgctcgatatgcgtctctacaccagagaagagctgctccatgtggatgcgctcttaaaggaactgctcggcacgatattgcatatcatggagcagaatacggagacgatcatgccgggtttcacacacctgcagaaagctcagccgatcacgctcgcgcatcacatgggggcctattttgagatgtttaagagagaccgcctgcgcctgcatgacatctacgagcggatgaattactgtccgcttggttccggagcgctcgcaggcaccacctatccgcttgaccgtgcatacacggcagaactgctcggtttttacggaccgactttaaacagcatggacggcgtgtctgaccgcgattatctgatcgaatttttgtctgcctgcgccacgatcatgatgcatctgtcacgcttttcggaggaggtcattatctggaattccaacgagtaccagtttgtggagattgatgatgcgtacagtaccggaagcagcatcatgccgcagaaaaagaacccggacatcgcagaattagtcagaggaaagaccggacgcgtctacggcgcgctgatgtcgcttctcacgacgatgaagggaattccgcttgcgtacaataaggacatgcaggaggacaaggagctttcctttgacgcgatggacacggtcaaaggctgtatcgcgctgtttaacggcatgctcgccacgatgaagttcaacagggagcgcatgcgtgcttcggcgaacggaggctttaccaacgcgacggatgccgccgactatctggtgaaccacggggtgccgttccgcgatgcacatggaattgtgggacagatcgtgctttactgcatcgaaaagggaattgcgatcgatgatatgagcctggaggagttaaaggcaatcagtccggtgtttgaggatgatgtctatgaggcgatctccatggaaacctgcgtgaacaagcgtctgacggtgggagcaccgggaaaagaggcgatggaacaggtgatcgcagcggagaagaagtacctggaggaagagtggaagcctcttgaaacttcaatacagtaacgtgacattgtgagaaatgtacaagaactgtcaaaaaaagccgggaagttttacgaaaaaagcattgctttttgacgggaaatggcataatatattcactatgacgacacttgttcgccaccgacggacacgaacagtgcaaaaagcaggtacgtgtgatgatccggcagaggcaatgagaggcggagtcgtatgccacagcgggtgtcataagaaaaagatgaggagattagaagagtcatgagtgaaaagttgagagttggtattctgggtggtacaggtatggttggtcagagatttatttctctgctggagaatcatccgtggtttgaagtgacaacgatcgcagcgagcccgagaagtgccggtaagacttatgaggaggcagtcggagaccgctggaagatggacacaccgatgccggaagcagtgaaaaagattgtcgttatgaatgtcaacgaagtggagaaggttgcggcagaggtcgatttcgtattttccgcagtggacatgacaaaggaagagattaagaagattgaggaggagtatgcgaagacagaaactccggtcgtttccaataacagcgcgcaccgctggacaccggatgtgccgatggtggttccggaggtcaacccggagcatatggaggtcatcaaataccagaaggagcgtcttggcacaaagcgcggtttcgtggctgtaaagccgaactgctccattcagtcttacgcgccggtgcttacggcgtggaaggaatttgagccgtatgaggtggtggcaacaacctatcaggccatttccggagccggcaagacctttaaggactggccggagatggttggcaatatcattccgtatatcggcggtgaggaggagaagtcggagaaggagccgcttcgtatctggggacatgtggacccggagaagaaagcgatcgttccggccaaatccccggtcatcacctgccagtgcatccgtgtgccggtgttaaacggtcacactgcggcggtgttcgtaaagtttaagaagaacccgacaaaagagcagctgatcgaggcacttcgcaatttcagcggtgttccgcaggagttaaagcttccgagcgcaccggagcattttatccagtatctcgaggaagataaccgcccgcagatcgctctggatgtcaactatgagaacggtatgggtatctcggtaggacgtctgagagaggacacggtctatgactggaagttcgtgggactgtcccacaataccgtgcgcggcgccgcaggcggtgcagtgctctgcgcagagcttttgaaagcacagggatacatcacagcgaaataaagaataaaaaagaatcctgcttgcaggattcttttttatttcataggaaatagcgtgatacgttaatgtgtgaaagtagaacttccctatgaaaataaaaaacgctccgcgaggatgcgcagctcgcggtaaggaaaatatcgctttgcgaaccgcttgcgcgcggagaatttcgcaagcgagattcttttttattgcccggaaagttaaaaaatgatataatttccgcagaacatatggacagatagaatgtgccggatatgggatgcggtgtggcttttcgtgcccggcaggaaagtgcagaggagaagagatggtcgtaaaatcgtcggtgttaatggaactggaagagtgctaccgggaaccgggcaatcagctggttgtgctgtacgggcggacggactcggagaaggagaggctgcttagcgcatttgtgcagaacaagaagcatttttattaccgcgcgagacaggtggcggagcgagagcagcgcgcgcagatggggcgtgaactgacggcgcggtttgaggtgatgctgcagaagtatacctatgaggaatattttaaccgggtaaagagcggtgatcccacgaagctggtagtcgtgatcgatgaatttcagtatattgccaaaaaggatcctacttttatggaggcggtgctgaaactgaaagcgcacaggctttatccgggacctgtgatgattctgctctgcagctcggcggtgtcatgggcagagcgggaacttccagagtgtatcggtgaggcggcatgccgcaaaatagaccggaaaatcaaatttacgaatctgaattttctggaagtggtgcgggcgttgcccgagtatccggtggcggaatgtatcaagacttacggcatcatcggcggtgtgccgggatacatcaaccgctggaacgcaaaagcggatgtaaagaccaatatctgtagactgattctttcgccgggcggctatctgtaccatgcggcggaagatctgatcggggagagtctgcgggaactgtctgtctatgagaccatcctggcgcagatcgcggccgggcaggacaagctgaatgatctgtaccggacgaccggattctcgcgcgccaagatcagcgtctatatgaagaatttggcggcatttgatatcatccagaaggtggtatcgtttgagacgggcggctgggagaacacgaagaaaggtgtgtatcggatctgcgacaattatgtgaatttctggtttcactttatctatccgcatctgtcggatttgtatatgacccgcccggaagaattctacgacagatatatcgcgcccggactggatgcgtacctctcccggtattttgtggaggtatgcatggaatatctgggacttctcggtatggtgggaaagcttccgcttaagattgcacgcatgggaacctgggttggcaaagaggggaatatcgacatcattgcgcagaatgagattcgacagaatatggtcggactctgcaactggcaggaacccgagcttacgatggaaatgtgcgaggcgctgttccttaacatgaagcgggcaaaaatcggcgcggaatattatttcctcttttccgcacagggatttgcaccggaggttaccgccatggcggagcgggataagcggttcgtgctcgtggatatgaatgaactgtaagttgcccgatgtcgagaaaaatgctataatttgcttcatgcgaaagtaattggaggaacagattgtggcaaaatctttgatcatcacggagaaaccgagtgttgcgcaggagttcgcgcggattctcggcgtatccggaagaaatgacggttatatagagaacgacgggtatgtcatcacctggtgcgtggggcatctggtggagatggtgtacccggaggagtatgatgagcggtataaaaaatggcggctggaagatctgccgtttctgccgcgggattacaaatataatgtaatcccatctgtgagcaggcagtatgatgtggtacataaaatgctgcaccgcgaggatattgacacggtctactgggcaggagatgccggaaaagaaggacagacgatcgaggaaaatatccggaagttcggcggcgtgcgcgagggcatgaaggagctccgcgtctggatcgattcgcagactgaggaggagattctgcgcggcatccgtgaggcaaaagatatgtcggagtatgacaatctcgcaaagtcgggtgtgatgcggacgatcgaggattatgcgatgggaatcaatttttccagagccatgtcggtaaagtacggaaaacttctgaatgatgcggcgggaacatcgagctatacggcgatcgcggtcggccgcgtcatgacctgtgttcttggcatggttgtgatccgggagcgcgagatccgcaattttacagagacgccgttttaccgtgtcgtgggaacctttcatcccgaaggagaggaagaatgccggatcacggcggagtggaaggcaatagaaggctctaaatattttgagtcgccgcttttatataaggaaaacggctttaaaaaggaagagagcgcgcagacgctgattgcggagttaaagggacaggaagcgctcattgattccgtggagacagggacgcagaaaaagcgtgcgccgctgcttttcaatcttgcggagctgcaggcggagtgttccaagcgttttaagatcagtccggatgagacgctgcaggtggcgcaggatctgtatgagaagaagcttaccacctatccgagaacggatgcacgtgtgctctcctcggcggtggcaaaagagattacaaaaaatatcagcagactgaaaaattttgcgccggtggctccttatgtggagcgcatcatgaaggaaggccgctgccggaacattgcgaacacgcagtatacggatgattccaagattaccgaccactacgcgatcattccgaccggacagctcacagagctggaatctttaaacagtcttgaacgaagcgtctatgagatgattgtgcgccgtttcttaagcattttttatccgccggcggagtatcagacggtgaagcttgtcgttgcggcaggcggtgagaagctttacacttccgcgaagcagttaaaggttccgggctatctggagattgcaggcattccgaaatcggcgaaggagcggaatgcggcgaagacggacggggaggagcagacgcagggcggtgatgctgaggctgcacaggaagaagaggagaacgccgggcttttggcgtatgccgacaagcttcaaaagggagagacgcttttttcggacggctatgtcatccgtgaggggaagacctccccgccgaagcgttacacgtcaggatcgatggtgctcgccatggagaatgccggacagctcatcgaggaggaagaattaagagagcagatcaagggttccggaatcggtacatctgccacgcgggcagagatcatcaaaaagctggttcgggtcggctatctgaatctgaacaaaaagacgcaggttctcacgccggagcggctgggggaaatgatctttgaggtggtttcgatgacggttccggcactgctcaaccccaagatgacagcttcctgggaaaagggactggacggaattacgcggggagcggtcgtgatggaggattaccgctcaaaactggaggattttatccgcagggagacggtcgccatgatcgagcaggatctgaccggccagattgccacgcggatccacccgctcgtcggaaagggcggaaaggggcttgcggcgaagcgcagcctcggcattccctgtccggtgtgcggaggaacgatcgagacgacgccgttcggttacgggtgcagcaattatcagaaagatggcggcggatgccgcttctccatcggtacaatcgccggaagagacttaaacgatgaggaagtaaaggagcttttgaccgaaggacataccggcgtgctgtccgggtttgtctcgaagtcgaagaaaaagttctcggcgagcctcatcctggaaaaggatgatgagggaaaagtttcggttggatttgatttttcaaagaaccagccggaaatcctggagggtgtcgtatgtccagtgtgcggttctgccgtggagatcacgccgtttggctatagctgcgtcaagcaccacgagcatcccgatgaatgttatttttccgtgggaaagatcgcgggaaaggcgctgggcgtcgatgatctgacggagcttcttacgaccggaaagaccggtctgatccgcggctttactgccaggaataaaaagaagttcaatgcctgtttaaagctggagcagacggaggacggaagaaagaatattgcatttgatttttcacagaacgatgccgccgttgttcccgatgtcgtgtgtccgatctgcggcggggcgattgtggagacgtcgttcgggttcggctgcgcgaattacaggcaggatgacccggacagctgccggtttgcaatcggtacgatggcgggaaaggacttaaacgcagcgcaggtgaaggagcttttaaatcaggggagaaccggaacgatccgcggattcaagtcgaagagcgggaagaagtttgacgcctgtgtcgctctggaacacacggaagacggaagaattgaattgagatttgattttgaacatgtcgaagccaaaaagatcaaggatgtggtgtgcccgatctgcggcggtgatatcgtggcgacgccgttcggctttggctgtgccaattatgtgaaggacgatccgaacagctgccggttctctgtcgggaagatggcggagaaggcactgacggaagcgaacgtaaaggagcttctgaccaacggaagaaccggaacgatccgcggctttaagtcgaagagcgggaagaaatttgatgcgcgcgtcgcactggcaaaggatgagaagggaaaggtcacggggctgaagtttgattttacggatctggaagcgccgaaggtaaaggatgtaaaatgtccggtctgcggcggagatatcgtaaagacgatgtttggatacggctgtgccaactattcaaaggagaatccggacagctgccggttcgcaatcggcaagatcgcgggtgtctcattaaaggaagcacaggtaaaggaacttttgctccgcgggaagacggacgtgatcaagggatttgtggcgaagaccggcatgaagttcgacgcgccgctgaagctgacgccggaagggcagatcgcatttgattttccggagaagccaaagcccgtcgagacaacacttgcctgcccgaaatgcgggaaaatgttaaagaagagccagtggtattacgagtgtgagtgcggttttaaggtctcccacacggtggcgaaggtggcgctgaccgaggaggtcatgcgcgaactgttagagacagggaaaaccaaagataaagtgaccgggtttgtgtcaaaagccggcaacacgtttgacacctgcctaaagctggaggatgaccgcattgtgtttgattttgacaatcccggcacaaagcgtgagggtgcttccgacggcaagggcggggagcgcatgttctatgaggaattagaagaaaatgcacagccgcagccgctggcggctgaggacggcgcacagtacattgaggaggacgtgcctccgttttatgatgcgatggcggaggagtatgcggcttacgaggaggaagaggcaaaacagcaggcggctgcatccaattttctggatgaatttcctggatgagaaacgaatgagaaaagaaagtaaaaatcggatggcgtgcggtgcatgcttgctattgacagccggataaaatgtcattaaaatttgagtagttattgatagaatccggcagaagacacaggaggaaacagggcatggagtacaatgagcaggcctttaaagagaaagccaatttaaaggcaatgaaagtatggctggctttgattgcgattatgacactgtcatacggaagcgacctttccaagggaatctatacggcgacgcagtatgttgtttttctggttatggcgtgggtgccgtttgcaatcggactgctgacgttgaagttaaaggggagagcgacaccgtgttataaggatgtcctggctctcggatatggctttttctatgcctatgtggtgtgtatcacggactcggcgaccgcctatgcatatattctgccgttgacgagtatgttgattctgttcaaggatcgcagttatatgatacggtgcgcggtcacaaacgagatcgtcattgtgctcagtgcactgctccatgtcttcctcggcctgaatccgaatgtgaaaatgacagactattacctgcagttttcaacactgcttctgtgttatatctgttatattctttctgtcgaccacttaaatgagtcggacggagcgctggtggcatcgatccgggataatctgagccgggtcgtgacgacggtgggacaggtaaagggagcgagcaactcgattgtggacggcgttacggttgtgcgtgagctggcggatgagaaccggcagggagcggattccgtcgtaagcagtatggaggaactcacccggaacaacgatgttctccacaataagacgatgtcctccatggaccggagtaccgacatcagcacgcaggtgcagaatgtggcgggactgatcgatgagatggtgacgctgatccaggagtcggttgagcatgcggatgtgagtgcggaagaacttgcggatgtcatgaatacgacggataccatggcggcgctttccggcgaggtcgagcaggtgctcgagaactttaagcagaaatttgaaatggtaaaggaagagacgggtaccatagagggaatcacgttccagacgaaccttctggcactgaacgcttcgattgaggcggcgagagccggggaagccggaaagggctttgccgtggtggcaggtcagatacaggatctgagcatgggaaccaagacttcttccggacgtatcagggacgcactggatcatctggaggagacttcggagaagatgacggaatccatcaccaagacgcttgagatgatccgcatgacaagagagaagctcacgcaggtgcaggagagtgtcacaagcattaccgatgattccaaaaagctgggacagaatatcggggtaattgacggcgctatgaaggaagtggaagcttccaacagcgacatggtggagaacatgaagcagatctgcgataccatggaggtcatgacggagtgcatcaaccagtccgacgaagcgtcccgcacgatgctcagcaaatacgaggagtcttccgtcaatgtggataagattgagagtgtggtaggaaagctcatggaagaactcggtagcggcggattcatgggaattggcgatgcgcagccgggaatgcatgtggtgttagtcgctaagaacggagcacaggcagccgggacggagttccacggggaagtgtttgagagtcagagcgacggagttctggtaaagatcaagccggaagccggaaaaacgattgagataaagaaaaaagacattacatatgaactgcagatctgtgtcaacaatgcactgtatacatgggaggatgtcagcgtatccgccgcttccaatgcgggtgccgacagctaccggattgctgtggcgacaaacccgaaggtcatcaaccgcagaaagtatccgcgtatgccggttgccaatgcatgtaccgtgacgctgaaaaaatccggcaaagcttacaacggcaggatgatcaatatcagcgcaggcggtttcgcattcagcgcacatcaggaggatttcgcaaatgcgatcgggcaggatattttgctggaaatcccggacttcccgctggaggaggcacggacgctggacggacatatcatccgcagtacggataatgatggtgagttcattgtcggatgccgtatgccggaggacagcgaagagatccaggcttatgtcaataaaaattacagggaatagagaggaatttgtgtgatggaaacagcaaaaatcagccagttatatgacttaggggagacgattgcggcggaactgtttgcgggactgacctatccgtgggaggctctgccgaaaatcagcggctttataaagaagctgggaccgacgcttgacccggaggtctatgagcagcgcggcgagaatatctgggtggcgaagagtgcgacggttgcaccgactgctttcttaaatggacctttaattattgatgaggatgcggaaatcagacactgcgcttttgtcagggggaatgccatcgtaggaaaaggctccgtggtgggcaattcaacagaattgaaaaacgttgtgatttttaattccgtgcaggttccgcattacaattacgtgggagattcgattctcggttacaaatcccatatgggtgccggctcgatcacttccaatgtcaagtcggataagacgctggtggtggtaaaggatcatgatgagaaaattgaaacagggttaaagaaattcggagcaatgctcggcgactatgtggaagtcggctgcaattccgtgctgaatccgggaaccgtcatcggaagccacaccaatgtttatccgctttcgagcgtgcgtggcgtggttccggcaaattcgatttacaagaaccgcagcgaggtagtggaaaagcggtaggacaacagaagagggacagagacaatgaagagaagatgggtgcagggaatgcttcttgcaggaatgctgattttgacaggatgcggcgcaaagaacagttcacctgtggagaacggtaaagattatacatggaacgacattacagtgatgcttccggaagactgggcggaccgctgtacgatcaaagaggatgagaatggatttaccatctatcagacggcttcctatgagaagatggaaggacttggctacctgtgttcctttgaaaaaagcgacgcatggatgaattacggtgcgggagagaacctgatcgcctacacggaggacggaacgctgtattacctgatgcagccgacggatgttgcgtgcgatacggaggatcagacaatcgtggaagagtacggatccatgatggaggaggtcacggccatcgcatcaagtgtgaagatcgatgcggatgacgttcattacgatgccgatcagtatgtcgttccggttggcgcaatactgccggtgacggaggagaatctgtcggatctgtcagagcaggaactctatctggcggcaaacgagatttatgccagacatggaaaaacctttgatgacacctacctgcaggcgcattttgatgcgtgcagctggtatacgcccgccgggggagcgactgcaggcgatgcgggattaagtgagattgagcaggcgaatctgaaactgatcaaggcaatgcagacggcatatgaagcggaacatatatatccgaaatcctattcggcaggcgagaccgcagagatcgctcttttggacaatggagttcttaacgaagtcagctacacggtaaccggtaagggggagcaggtggtctgcacgctcacgatcgacgggacagcgtacgaccttgccgagtacattcagatgcacgcgccggttgaggatgcgttttatgtgacagaccttgtggagaacatcggaacaccggaagaggatgatggtctggagattgccgtacttgatgaaggaacagatggcatcggggcgacccattttttcaaatatgatggagatctttactatctgggagaggtcggaggattcccgttccgggaccggaatgccggattcagcggttttaacggccagggcggtgtgatggatctgatccgttacgacaagccggcagactgcatcctgcaggggtatgcctggtacaacagttcggagaagaagatcgagcatgcggacggcgggctttattcctattacgagccgtgtaagctggagcataagggagcactgaccgtgtatttttcgatggatgagacatcagcagaacagacgattgcggcaggggaggacatctactgtatccggtcggacggagacggttggatgtatgtgcgtgcaaaagacggaacggaagggtttttacctgtgacgcaaatgtaagaaaagcagctgttttgacaaaagtgcataaaatttgcagtacccacttgtgaaaatcaagaaaatgtgagagaataaatgcagtatgttaaatgtgtaacaatgtttaacaactcagttctatttatgcgaaaggagtcttaaaatgatttacactaaggaagttgaaaacatgtgcccagtcgcaaagggcgcaaaacatgaaccagctccgattccggaagaaggcaagtgggttcattccaaaaaaattgaagatatttcaggctttacacacggtgtaggctggtgtgcacctcagcagggtgcctgcaagctttccctgaatgtgaagaatggtgtgatcgaagaggcattagttgagaccatcggatgctccggtatgacacattctgcagctatggcagcagaggtattacagggtaagaccatccttgaggcactcaatacagaccttgtctgtgatgccatcaatacagcaatgagagagttattcttacagatcgtttacggtcgtacacagagtgctttctctgatgatggacttgcaatcggtgccggtcttgaggatttaggaaaaggacttcgttcccaggttggtaccatgtacgcaaccaaggagaagggcgttcgttatctggagatggctgagggctatgtaacaggtatcgctcttgacgagaacaacgaggttatcggataccagttcgtttctcttggaaaaatgactgacttcatcaaaaaaggcgatgatccgaacactgcttgggagaaagcaaagggacagtacggccgtgtagcagatgctgttaaaatcatcgacccgagagaagagtaggaaaggagacggacgaaaatggcattatttgaaggatatgaaagaagaattgaccagatcaacgctgtattaaacagctatggtatcagctccatcgaagaggcagagaagattaccaaagatgctggtttgaatgtatatgatcaggtaaagaagattcagccgatctgtttcgagaacgcttgctgggcttacacagtaggtgctgcaatcgcaatcaagaaaggatgcacaaaggctgctgatgctgctgcagcaatcggtgagggtcttcaggcattctgtatcccgggttctgttgctgaccacagaaaagtaggtcttggacatggtaaccttggtaagatgttattagaggaagagaccgagtgcttctgcttcctggcaggtcacgagtctttcgcagctgctgagggtgcaatcggtatcgctgagaaggcaaacaaagtacgtcagaaacctctgcgcgttatcttaaacggtcttggaaaagacgctgcacagatcatctctcgtatcaatggatttacattcgttgagacacagtatgactacaaggcagcaaaattaaacgttgtatacgagaaggcatactccaacggacttcgcgctactgtaaagtgctacggtgcagatgacgttcaggaaggtgttgcaatcatgcatcacgagaacgtaggtgtttccatcaccggtaactctacgaacccgacacgtttccagcatccggttgcaggtacatacaagaaagaatgtatcgagcagggtaagaaatacttttccgttgcatccggcggtggtacaggccgtacccttcacccggacaacatggcagcaggtcctgcttcctacggtatgacagataccatgggacgtatgcactctgacgcacagttcgcaggttcctcttccgtaccggctcacgttgagatgatgggtctgatcggaatgggtaacaacccgatggttggtgctacagttgctgttgcagtaagtgttgaggaagctcacaaagctggtaagttctaagtagtatcgtatttaattgaaaagcagggaatatactttaagcggtatgttccttgctttttattctataaatttcttgattttccagtgaagatctttctcaaagctttgaaaaaatcccttgccaaaccgcgcacattcgtgctatgctactttgcaacagtgcagtattacatggagaggaatggaacggttatgctaaagatcattgatgattttgtctggggagttcccctgatcgtgctgatccttgcggttggcatatttctgacgatccgtctgcggggacttcagatcacgaagctgccgcttgcggtcagacacattattgcaaacgaaaaagacggcaaggacggagaggtgtcgagtttcggcgcactctgcacggcgctgtcggcaacgatcggtaccggtaatatcgtgggagtggcgacggcggtcgtggcaggcgggccgggcgccttgttctggatgtggattgcggcgctgtttggcacggcgaccaagtatacggaatgtcttttggcgatcaagtaccgcgtggtggaagcggatggacatgtggtcggcggaccgttttactatattgagaacggtatgggcagaaaattccgctggctgggacagatcttcgcattcttcggcgtgggagtcggtctgctcggcatcggaacctttacgcagatcaacggaattaccggtgcggtaaagggcttttttgatccggagacggcatgttcggtgcatctgtttagcaacacctattcgtggagcgttgtgatatccgggctgatactgaccgtgtgcgtggcactcgttattatcggagggattaagcggatttcctccgtggcacaggtggttgtgccgtttatggcgcttgtgtatgtggtgactgtgctgatcattctgctgacgcatttgggagagattccggcagcacttgccaccatcgtacaaagcgcgtttggactccgtgcagcggcaggaggaacacttggcgcaatccttgttgcgatgcagaagggaatcgcgagaggtattttctccaacgaagcggggcttggaagtgcgccgatcgctgcagctaccgcgaagaccgatgagccggtggcgcagggactggtatccatgatgggaacggtgatcgatacgctgattatctgtacgatgaccggattgtccatcatcatcacggatacgtggaacatcggtctggacggggtggatgtcacgacaagagcgtttcagatcgggcttccgttcccggaacgcgtctcctcgtttttactgatgctgtgtctggtgttttttgcatttacaacgatccttggctggaattattacagcgagaaatgtctggaatatctggtgggcaaccgtcccggggtgttaaaatgctatcgctggctgtatattctggcggtattgatcggaccgtttatgaccgtgtcggcagtctggacgattgcggatatttttaacggactgatggcgctgccgaatctgattgcactggtggcgctaagcggtgtggtggcagccgagacgaagcagtattttgcaaaacagaagaatttttgatggttttgccaaaggacagagtaagttgttggatactctgtccttttttctgctataatagagaaaaaaggagggcgcagatggacgaagcacacgtgtatattgcaattgatttaaagtctttctatgcatcggtagagtgcgtggaacgtgggctggatccgcttacgaccaaccttgtggtggcagaccccgagcgcacggaaaagacaatctgtctggcagtatcaccttccctgaaagcctatggcattccgggaagagcgaggctctttgaggtcgtacagaaagtaaaagaagtgaatgctgggcatccgaaagagcggctgacctatcagatcgcaccgccgcgcatggcgctctacatggattacagcaccagaatttacaatctctatctgcgttatgtggcgccggaggatattcatgtctattctatcgacgaggtgtttatggatgtcacgcattatctggggacataccacatgacagcgagagaacttgcggcgaaaatgatacaggatgtctttgctgagacgggcatcacggcaaccgccgggatcggaaccaatctctatctgtgcaaagtggcgctcgatattgtggcaaaacatgtaaagccggatcggaatggtgtgcgcattgcaaaactggacgagatgagttaccgcagactgctctggaattaccgtccgctgacggatttctggcgggtaggacggggctaccagaagaagctggaggagaacggtctgtatacgatgggagacattgcgcgctgctcgctgggaggagccagagagttccacaacgaggaattgttataccggctgttcggcatcaatgcggagctgctcatcgatcatgcatggggctgggagccggtgacgatggaacagattaaggcgtacagaccgcaggtgaacagcataagttcggggcaggtactgcattgcccctacgacgcgaagggcgcgcggctggtggtgcaggagatggcggatgcgctggcgctggatctggtggaacggcgtcttgtgacggatcagcttgtgcttaccgtcggttatgacattgaaaatattacaaatccggcactttatgcagactatcgcggagagattgtggcggaccgctacgggagaaagattcccaagcatgcgcacggtacggtcaacctgaaaaccagaacctcctcttcccgtaagattatggaggcggtgatggggctgtatgacgacattgtgaatccaaagcttctcgtgcggagaatcacgcttgtgggcaaccggctggtggaagaagcccgcgccgaggcggaagaacaatacgaacaactggagctttttacagatacaggcggacaggaagaggagaaaaaacaggaagaactgcggctgaaaaaggagcgcagcctgcaggaggcaatgctttccgtgaagaaaaagtacgggaaaaacgcgatgcttaagggcatgaatctgcaggagggcgcgaccgcgatggagcggaacagccagattggagggcataaggcataatgggctgggatcatgcggcagaggaacacaaatatgacgatatacggatgcttgtgcatcacagatcgcgcgtgcatccgccgatgtccctgtgggatcgggcggcgcagttctctccgtttgccgcgttgagcggacacgaggacgcgatccgcgagacggcacgtcttacgacggagcgcgcagagctttccgagagccgcaaagaggagttaaacgagcagctcgtctggctgcgggagcacccggatgcgagagagcgggtgacggtgacctattttcgcccggacgcgaaaaaagcgggcggtgcctatgtgacagtcaccggagcggtaaaaaagatagacgaatacgaaaagacgctttggatggaagatggaaccgtcatagcgattgaggaactgtctgcggttgagataccggggaaggaccgatatgaggaagaatagaaggagcagcatgaagatggaaacacaaagatacctgtatgagacacatatgcatacatcggaggcaagcgcatgcgccggcagcacgggtgcccagatggcgcgcgcctacaaagaggcagggtacaccggcattattgtaacggatcactttttttacggaaatacttcggtggaccgttccctgccgtgggaggagtgggtacggcgcttctgtctcggatatgagcatgcaaaggcagagggggaacgcatcgggctctcggtgttttttggatgggaagcatgttatgaggggacggagtttttggtatacggactggatcaggcatggctgcttgcacatccgcagattaaggatgcatcgatcgaagaacagtacgcgctggtacatgagggcggcggcattataagccatgcgcatccgttccgggaggaggattacattcccgaaatccggctgtttccggaatatgtggatgcggtggagggcgtaaacgccatgcattcgagcagggcgagcgactgccacaagaacccgctgtttaacgagcgggctctggcctatggaaaagagcacaatctgccatttacagcgggatcagaccagcacaccacgcatatgatcggcggcggtatggtctttcccagaaaactaaaagacgtccatgactttacccgcgcggtgcttggcagagaggcggtggaactgttggacggctgcaaaagcgagtgattacgagcggttcttttcccggtattctttgggcgacatgcctttctgccggtgaaaggttttggaaaaatagagactgttgtcaaaccccagcgagtttgcgatcgcggtgatcgacaggctggagtgctccagcagatagcacgcctgcttcatgcggaaatccgtcaggtattccttgggggagcgccctaggacagcctcaaacgagcggaacagatgactgcggctcacgccgacatagccagcaatatcctccacggtgatggcgtaggaataatttgaggagatgtactcaatgcttttttgtacatagctgttcgcggaattctggctgccggcgtgcgtagcaccgtgcatgaacagggcgagcatggtatagagacgtcctgtcatctccaccgcgtgctcgaattcgttgccgcgtgcatcgtagatgtgcagaatctgccggtgaatatcattgccgcgtggggtgtcccgtataaaaggattctcaggggagaagtccgtggccttcaggatcatggaggcgtcgcttccggtaaaaccgacccaggcatactcccaggggttctgctcatccgcgcagtagacaacctcggtgtttgggtagaccaaaaaagtatctccgccggacagatggtaagtctgaccggcgacgcggtaggtgccttttccggaaatgatatagtggatcagatagtgatcgcggataccgggaccccattggtagagggcgtcacatttctggaagccgacgttgtagacggagagggaaaccagttctttttcggtcactttgtaggaatttttgtaatgatgcggcatagaacacactccttgtctttctgacagtaaaatccttatcgtataagtccattataaaaacagaaaagccgaaaagcaacattattacatatatttcatacattttgggctatacattttacggaggatagagtaatataattttcgtaaggcagatggaacaatgaatcataacggggaaaggtggaatcattatgacgattttagtaacaggcggagccggatatatcggcagccatacatgcgtagaattacagaatgccggatatgacgtggtagtgctggataatttaagcaatgcctccgagaagtccttacagcgtgtggaggcgctgacaggaaagccggtaaccttttataaaggggatatcttagaccgtgatatcctgaacaaaatctttgcggagcacaagatcgactgctgtatccattttgcgggattaaaggcagtgggcgagtccgtggcaaagccttgggagtattacaacaataacattgcaggtacgctgacactggtggatgtgatgcgtcagaacggctgcaagaatatcattttctcctcctcagcgacagtatacggcgatccggcagagatcccgatcacggagaactgcccgaagggtcagtgcaccaatccgtacggatggacaaagtccatgttagagcagatcctgaccgacatccagaaggcagatccggagtggaatgtgattctgcttcgctactttaacccgatcggtgcacacaagagcggcacgatgggagagaatccgaacggtatcccgaacaacctcatgccgtatgtaacacaggtggctgtcggaaagttaaaagaactcggtgtattcggcaacgattatgacacaccggacggtaccggcgtgagagattacatccatgtggtcgatcttgccatcggacatgtgaaggcactcaagaagattgaggagaaagcgggactctgcatctacaatctgggtaccggacacggctacagcgtgcttgacatcgtgaagaattttgaggctgcaacaggtgtgaagattccttatgtaatcaaggcgagaagaccgggcgatattgcaacctgctactgtgatccgtccaaggcaaagaacgagcttggctgggaggcacagtatggtatccgtgagatgtgtgaggattcctggagatggcagaagaacaatccgaacggatatgaagattaagatgtgaagcagcggacggggctgccacacgatattgtattttaaatgggatacgttttgcgataagaaaaggagactatcgcgttccagatgcaatctgggacagcaattctaatcgtaaaatccggtatttctaaccatgccgcgtcgaacattctggatgatctgtgtttttccaagtttcggacattccacaaggtgtgttcgtaatccgcagacaattttaggacttttgtgtgtgccccttgttggcaccaatgaacaaaacataaccgcgcgaagccgatgtctgagctgccatctgccttattttcaatagcagatggcagtgagtttcggttcacgcggttttatattgtctgtgaagcggtgccactaggggcaccagaaagtccgctcattgtctgtggatttgccggacacaccttgtggaaagtccaaacatggaaagacacagaattcgatgtccaacgcggcatggaagaaatattcggattttcctccaaagaattgccgcctccggttgcatctggaacgcgatagtccctttttcttgtcataaaacgtatcccggtaagatgcaaagcatgacaactccgttttctggaaataaaaaaagaaagcgtaaacgctttcttcttcgggttgggctgttattactaacagtagcagttcctaggggaatcgaacccctgttttcgccgtgagagggcgacgtcttaaccgcttgaccaaggaaccatacggtataccaaatatattatgaaattgagcagttcctaggggaatcgaacccctgttttcgccgtgagagggcgacgtcttaaccgcttgaccaaggaaccgaacaaatgctattataacaggctttcaaaaaaaagcaaccccttttttgaaatttttttaaaaagctgaaaattctgtacaattcgtgaaaaaaggagtatgatggattgcgatagagtaacgtggtaaagtgcaggaaagtaaaagcagaaacgatacttcctgacgcagaaagagaggtttgtgcgatgtcgctggagagggcaaaggcatatttaaaagaatataagatggaagatcagatccgggagttccccgtctcctcggcaacggtggaactggcggcggaagcactgcacacggaagcagggcggattgcaaagactttgtcttttctggtggacggagaggcggtgctgatcgtgtgtgcgggagatgcccggattgacaatgcaaaatacaaggcatttttccgtgcgaaggcgaagatgcttgcgccggatgaggtggaggaacggatcggacatgcgatcggaggcgtctgcccgtttggaatcaaggaaggcgtgcgggtgtatctggacgagactttgaaaaaatatgagacggtttttccggcgtgtgggagcagcaacagcgcgattgaactgacgataccgcagttggagcagcttgcaaaaccggtgtgctgggtagatgtctgcaaactgccggcataaaagcctgtattttcgagaaaaagcttgcatttcccataaaaaagtgctactttaatatatgataacacgatgacttgattgagagaggacgaaagccctctctcaattcacgtttatgccctgtaaagtctgtgtaaaggccgggtgggcagtttgttacaattaaaattgaatatggagaaagaaggtgtacacatgtcaaagcgtgaaacatacgaagcgcgcaccgaagaactgattactccgatcttagagcgcatgcattttgaactcgtggatgtggagtatgtaaaagaaggcggaacctggtatctgagagcctacatcgacaaggagggcgggatcaccgtcaacgactgcgaggcagtggcgagagagatgaatgagattcttgaccgcgaggacttcgtggaagattcctacgtgttcgaggtaagttccccgggacttggcagaccgctcaagaaagaaaaagattatgtccggagcatgggaaaggagattgagatccgcacttaccgtgcaatcaaccgggaaaaggaattttatggtattttatctgcatatgatgaaagtactgtgacaatagagacagaaaacggagagaaaatgacgtttgagaagccggatatcgcgctgatccgtctggcattcgatttttgataaaatatatgctaataaccactaaggaaacaggaggataataaaatgagtagtaataatgagttattagaagcattgaatatactggaacgtgagaagaatatcagcaaggagacactgcttgaggcaatcgagaattcactggtgaccgcctgcaagaaccatttcggtacatccgagaatgtaaaggtgacgatggacccgcagacctgtgagtatcatgtgttccaggagaagaccgtagtagagcaggtggaggatccggtagagcagatcagccttgtcaatgccaagatggtggattccaaatacgagatcggagatatcgtgaatgtcgagatccagtccaaggagttcggacgcatcgcaacacagaatgccaagaatgtcatcttacagaagatccgtgaagaggagcgcaaggttttatacaaccagtattacagcatggaaaaggatgttgtgaccggtgtggtacagcgttacatcggaagaaatgtgagcgtcaaccttggcaaggtggatgcgatcctgaccgagaacgagcaggtgagaggcgaggtattccagccgaccgagcgcatcaaggtctatatcctggaggtgaaggatacgtccaagggaccgaagattctcgtgtcaagaacccatccggagctggtaaagcgcctgttcgagtctgaagtgaccgaggtgagagagggaatcgttgagattaaagcgatcgcgcgggaggcaggaagcagaaccaagattgccgtctggtccaatgatccggatgtggatccggtgggcgcatgtgtcggtatgaacggtgcgagagtcaatgcgatcgtcaacgaactgcgcggtgagaagattgacatcattacctggaatgagaatccggcaatgatgatcgagaacgcattgagcccggcaaaggttatttctgttatcgcggatgcggaggagaagtcggcgaaagtcatcgttccggattatcagctttccctggcgatcggcaaggaaggacagaatgcgagacttgcggcaagacttaccggctttaagatcgacatcaagagcgagacacaggccagagagtccggcgacttcatggattatgagagcgagtacgaggacgacgagtattacgaggatgacgagtacgcagaggacggcgaatataccgaagacggcgagtatgccggggacagatatgctgaggatgcggatgccgagggagaatacgctgaggaatccgaacttgcggatgagacagacacagagaatgaagaagagtaggcaggggttgatcagagaatggcaaacaaaaagattccaatgcgccagtgcgtggggtgcagagagcttaagccgaaaaaagatatgatccgggtaatcaagacggcggcggaagatgaggcctcctcacagattgtacttgatgctacggggcggaaaaacggcagaggcgcttatgtgtgtccgaacagtgagtgcctgcgcgcggcaataaaaaacaagggtctggaacgatcattaaaaatgccaattccaaaggaagtctatgatacactgacaaaggagatggagaagtttgaaaccagataaagtgttgtcgatgcttggcattgcagccaaggcgggcggtgtggcaagcggagagttttccacagaaaaagcggtgaaggatggcagggcatggcttgtcattgtcgcgtcggatgcgtctgagaatacacagaagcatttccgggatatgacgactttttatgaagttccgatgtatgtgtacggagaaaaagagacattgggacatttcattggaaaggaattccgtgcatcgcttgcagtgacaaacgaagggctggcccattcgatcgaagataaattgaaactgacgttaacaactgaataatggaggaaacaggatatatggcaaaaatgagagttcatgaacttgcaaaagagttaggaatagaaaacaaacagattattgaatttttaagtacgacggagcatgcggtaaagtcgcacagcagcagcattgaggatgatgtgcagaaaatggtgcgcgacaagttccagaaaaaggcagcaccaaagacggagacagcgccgaaggcggaggcagcgccgaagaaggaagcagcaccgaaggcggaagcggcaccgaaggcggaagcggcaccgaaggctgctgagaacgcggagggcagaccggagcgtccaaagaagaagtccagcattaccgcggtatttaatccgcagtacagcaagcagggaggcggacgccgcccgcagggagaccgtgaccgccgtccgatgaacggagaccgtcgtccgatgaatggagaccgccgcccacagggaggcagaccggagcagcgtcaggcaagaccggcaaacagctttgatgtcaagagagcatttgagcgcgcaatcaacccggaggctgcaaaggcagccgaggaggcagagcgtcaggcagcggagcgcgcaaaggcggccagaacggcagcgccggagaaaaagccgcaggagacagcagcaaagcagccggaacgccgtgaaaatgtatacgagaatgtgtatgagaacgtatatgcacagaatccgcaggcacgcccgcagggagaccgtgaccgccgtccgatgaacggggaccgtcgtccgcagggagaccgcgacagaagaccgggagcaaacggagaccgccgtccgatgaacggggatcgtcgcccgcagggagaccgcgacagaagaccgggacagaatggatacggcaaccgcggcggcaataatggcggaggaagaccgtacggcggaggaagacctggcgcaaacggtggtcagggagacagaaacggaggccgtggcggcaatggttaccgcggtggcaacccgtccggcagactggatcgtgagatcgaccgtatgaacaaggagaccgcagcatccacagaggaactgcgcggcaaggagtccagagagcgcgagaaagaccgcaacaagaacgacagacagagaaacgattatgatgcacttggcggcaagaagcaggagcgcttcgtaaatctggagaagaacggcggcaagaagaagccgaaccagcagccgcagccgaagcaggaagaggatgtgattaagacactcgttctgccggagaagctgacgatcaaagagcttgccgataagatgaaagtgcagccgtccgtgatcgtgaagaagcttttcatgaaaggcacgatggtaacggtgaaccaggaagtggactatgagacggcggaggagatcgcgcttgagttcaactgcatctgtgagccggaagagaagatcgatgtgatcgcagaactcttaaaagaagaagacgatccggaagagacacttgtggcacgtccgccggttgtctgcgtcatgggtcatgtcgatcatggtaagacatccctgctggatgcgatccgctccacccgtgtgacagacaaagaggcaggcggtatcacacagcatatcggtgcatctgttgtttcgatcaacggtcagaacatcacattcctggatacaccgggacatgaggcattcacggcaatgcgtatgcgtggagcaaattccacagatattgcgatcctggtagtcgctgcagatgacggtgtcatgccgcagacgattgaggcaatcaaccatgcgaaggcggcgggagttgagattatcgttgccatcaacaagattgataagccgagtgccaatatcgagcgcgtgaagcaggagctgtccgagtacgaactgattccggaagattggggcggaagcacggtattttgtccggtatctgcacatactaaggaaggtatcgagaaccttttggagatgatccttctgaccgcagaggtacttgagttaaaggcaaatccgaagcgtaatgcgagaggccttgtcattgaggctcgtctggataagggacgcggtgcagttgccaccgttctggtacagaagggtaccttaaaggttggtcagccgattgcatgcggaagctgctacggcaaagtgcgtgcaatgattgacgaccagggaagaagagtcaaggaagcgggaccgtccacaccggtggagattctcggactttcatcggtaccggaggcaggcgagacattcgttgccatggatacggagaaggaggcaagagcatttgccgagacctatatttccgaaggcaagaaccgtctgatcgaagataccaaggcgaagatgtcgctggatgatctgttctcgcagattcagtccggtaacgtcaaggaactggatattattgttaaggcagatgtacagggttctgtggaggctgtaaagcagagtctggagaagctgtccaacgaagaggtagtagtaaaagtaattcacggcggtgtcggtgccatcaacgagtccgatgtcagccttgcatccgcatccaatgcgatcatcatcggattcaacgttcgtccggacccgatggcgaagacaacagcggacaaggagaacgtcgatatgcgtctctacaaggtcatctacaatgcgatcgaggatgtagaggcggctatgaagggaatgctcgacccgatcttcgaggagaaggtgctcggtcatgcggaggtgcgccagatcttcaaggcatccggaatcggaaatatcgcaggttcctatgtgcttgacggtgtgttccagagaggctgcaaggttcgtatttcccgcgccggagagcagatcttcgagggtaatctggcatccttaaagcgtttcaaggacgatgtgaaggaagtaaaagccggatacgagtgcggccttgtctttgagggctttaatgacattgcagagcttgatatcgttgaggcatacacgatggtggaggtaccacgttaacaaacgttttgcgtgtatggaaggagctataaattgagaaaaaacagtattaaaaatacccggatcaacggggaagtgctgcgcgagttgtcgaatatcatccgcggggagatcaaggacccgcggatcaacccgatgaccagcgtggtcacggtggaggttgcaccggatctgaaaacctgcaaggcctatatcagcgtgctcggggatgaggaatcccagaaggcaacgctcgcaggtcttagaagtgcggagggttacatccgcaggcagcttgcccacagcatcaacctccggaatacgccggagatcacatttgtgctggatcagtccatcgagtacggtgtgcgcatgtccaagatgattgatgatgtgacaaaggatattccggatcggacggatgaggcagaagaggaaacagaagaatgacgaattttgatgattttctggcagaggttcatacggttgccatcggcggacacatccgtcccgatggcgactgtgtgggctcctgccttgctacttataattacattaaaacatggtatcccgacatcgacgtgacggtttatctggagccgattcccaatattttcaaatttatggcgcgctccaatgagatcgtctccgatttttccggggatacggtatacgatctgtttatcgcgcaggactgcggggatacgggacgtctgggcggtgcggcgcatttctttgagcaggcgaagcataccgtctgtgtggatcaccacatcagcaaccagagctttgcacaggacaactacattttcccgcaggcaagttccgcgtcggagcttgtctatgaactgcttccaaaggagcgcatcacaaaggagattgccgagtgcatttataccggaatggtacatgataccggcgtcttccagtattcgtgtacgtcgagaaagacgatggagatcgccggagcgctgatggagtgcgggatcaattatccgaagattgtggatgataccttctacacaaagacatacaaccagaaccgcattatggggcttgcactgttaaagagcaggctgcacctgaacggaaaatgtatttccagcgtgatcacggaggaggagatgacgcagtatgacgtgctgccaaagcatctggacggcattgtgaatcagctccgcgtgaccaaggatgtggaagtggcagtctttttgtatgagacgggagacggcacgtttaaggcgagcaccagatccagggaagtggtggatgtctcgaaggtggcggtaaagtacggcggtggcggacacatccgggcagccggattttccatgactggcgatgcggatgccatcatcgaacagattatttcggatctggcagaacagataaagtgagaaaaaagcagtatgatgaatggaattatcaatatctataaggaaaagggatttacctcgtttgacgtcgtggctaagcttcgggggatcttaaagaccagaaagatcggacacacgggaacgctggatccggatgcggagggggtgctcccggtgtgtatcggcaaggcgacgaagatctgcgaactgctgacggacaagacgaaggaatacgaggctgtcatgctgcttggaagaacgacggacacgcaggatgtgacgggcgagaccctgacgcagcaggaggtgcgctgcagtgcaaaggaagtggaaaaagcggttctctcgtttgtaggtgattatatgcaggtgccgccgatgtattctgccttaaaggttgacggcaggaagctgtgtgatctggcacgggccggcgtgaccgtggaacgtgcggcgcgtccggttcatattttttccatcgagatcctttcgatcgaactgccgcgtgtcaggatgcgtgtctgttgttccaagggaacgtatatccgcacgctctgccaggatgtgggggaggtgctcggctgcggtgcgtgcatggaatcgctgctccgcacgagagtcggagagttcgcgcttgcggacgccataaagctgtccgaggtggaggcgtacgtgattgcacacaggtcggatgcgacggagacagaagaactgcagcttccgttccttcaggcggtggataccgtctttctaaaatatgagagcgcgacggtggacggacagttccgcaaatatttatataacggaaaccggctgcgcccggagatgtttttggaggaacatgagagtatgagaatggcgccggtccgcgtctacgacgatgaaggcgcatttttcggcatttatgaatatcaggcggaaaaggaagactataaaccattaaaggtgtttaagtagatcatgaaatatatcaggaacacaacggatttttatatagaagagaatacggtactttctctcggcaagtttgacgggattcacagggggcatgagcagctgctgcagtattttgcaaagaaaaaggacgaaggtctcgcgggagcgatttttaccttcgacattccacctcgcagaaatgtgcagaatgtggaggcgaaggtgctgaccacgaatgaggaaaaaaggcacatgtttgagcacctggggattgattatgtggtggagtgcccgtttacgcaggagatcatgtgcatggagccggaggatttcatcgctaagattgtgcggcagcttcatgtaaagtgcatggttgtgggggaagactttcatttcggacataaccgcaggggcgattaccatatgctgcggcagtatgccggaaaatacggatacgaagtgatcgttgtggagaaaataaaagaagacagccgggacatcagcagcacgttcgtgagggaagagatcgcagccgggaatatcgagaaggcaaatcatcttctgggataccgttactttgtgaccagcagagtcctgcacggcaaccagatcggaagaacgatcgggattccgaccatcaaccagctgccgccgaaggagaagctgctgccgccgaacggtgtctacgtgacggaggcatacatcggagaccggtggtaccgcggcatcagcaacgtggggtgcaagcctacgattgagggagagtatcctgtcggggtggagacacatctgctggatttcgcggaagatgtctacgataagatggtgacggtggagttcttaagcagagtccgcagcgagcggaaatttgcatcgattgaggcgctcaaagagcagatgcagaacgatgttgcctatggccgtgcctattttgaaaaacacacctcgtaataattattacataaatgttacaaaaatatgttgacatcgtaaaaaatcgttgctatactggacgttagatttaaaaatgagcacaaactagaattgcgcaggagacggcgcaagaatggagagtcatatgaaagcacgattagcgagaatcgcaggtttggtcctggcgggaactctggtggtttccacagcggcaatagatcagaagtcaaagaatacagatgcggataccagtgcaaccgtggcgtccggtgttaccagcgcactgtccggaagtctcagtgacgcggcgatgggcgtggccggtgtttccggaatggacattgcaagaacggcacagggacaggaagcggttgaagagggcaccgaatcagcagaggcgggtgtggatgtggatgcatcgacgtcttctgccgctgccggagtatcggcagagcttgcagatgcagcagccgcggcctcacaggcgcaggacgaacttacagagacggagagcacagaggagcagacagagagtacagagcaggatgccgcacagcaggcggcgagcgcttacggatataccaatctcggtgtggcgaatgttgagggcaatctcaacgtccgtgcagcggcaggcactgatgcagatgtcgtgggcaagatgccgaacaacgcaggatgtgagatcctcggcgtggaaggcgaatggacacagattaagtccggttccgtggaaggttatgtaaagtcggagtatcttctgaccggagatgcggcgcttgccagagcggatgaggtaaagcagacgcttgccaccgtgacgacgacaaccctttacgtcagagagcagccgaacaccgactgcgcgattgtcacaatgatgccgcagggcgaggaactcgaggtgctcgaggtgcttgacggatgggtgaagatcaacgtcgacagtgatgagggatatgtctcttccgattatgtagagatctcgacagagcttttaaaggcgatgaccatgactgagatccggtatggacagggtgtttcggatgtgcgtgtatcgctggtgcagtatgcgacacagtttgtcggcaatccgtatgtatggggtggcacaagtctgaccagaggtgcggactgctccggttttgtcatgagcgtatttgccaactacggcatttcccttccgcattcttccggcgcgcagtcgaattgtggaacgaagatttcggcctctgaggcacagccgggagatctgttcttctacggaaacggaagccgcatcaaccacgtggcaatctacatcggcaacggacaggtggtacatgcaagttcaccgaagtccggcatcaagatttccggtgcctattaccgtacgccggtcaaagttgtgcgtgtgatcaataattaaaaagttgtttacaagcgtatgcagctatgctataatgcgagagtatgagttcagcccatattcggtaaatggacactccaaccttttactgagtatcatacacagtcgggcgatgggcccaaagggcccggtatggcagaagccatccaaacagaatattataaggaggatcagaacatgatcgcaaaggacaagaagcagaacattatcgcagagtatggaagaacaccgaatgacacaggttcaccggaggtacaggttgctcttttgacagcacgtatcgaggagcttaccgctcacttaaaggagaacccgaacgatcatcactccagaagaggtcttttaaagatggttggtcagagacgtggtttacttgcttacttaaagaaagtagatatcgagagatatcgtgctttaatcgagcgtttaggtctcagaaaataagatgtccaaagcgggcagacatgcccgcttatcaatagagcggagagcttccccgctctatttttactgtatggaggcacttccgtgcagcatggcaatctgacagaagcgtatccccgagaccactgaaatatagatacgtgcagtgtatgtatttcagtagtttcggtgcttctgcagagtgattttgcgggatccttccggcagaaccgaagaagagaatgaaagagaatcagaaaaggagaattcgcatgtacaaaagtttttcgatggaacttgcaggcagaacacttaccgttgatatcggaagagtctgcgcacaggcaaatggagcagctttattaaaatatggagagacgaccgtgctttctaccgtgacggcatcggacaagccgcgtgacggcattgatttcttcccgctttccgtagaatacgaggagaagatgtattcggttggcaagatcccgggaggattcaacaagagagagggtaaggcatccgagaatgcaatcttaacctcccgcgtgatcgaccgcccgatgcgtccgttattcccgaaggattaccgcaacgacgtgacgatcaacaacatggtaatgtctgtagatccggcatgccgtccggagatcgttgccatgattggttccgcactggttaccacaatttccgatatcccgtttgcaggtccgtgtgcaacgacgcagatgggtatggtggacggagagttcatcgtgaatccttcccagaaggagtgggacaagggtgatctgcagctgaccgtggcatccacagcagagaaggtgatcatgatcgaggcaggcgccaatgagatcccggaggacaagatgatcgaggcgatctacaagtgccatgatgtaaaccagacgatcatcgcgtttgtcaataagatcgtggaagaggttggcaagccgaagcatgagtatacaagctgcgcaattccggatgagatgtttgcggcaatcaaggaactggttcctccggcacagatggaggaggctgtattcacagacgagaagcagcagcgtgaggagaatatccgcgagattacggacaagctggcagaggctttcgcagacaatgaggagtggcttgctgttctgggcgaggcagtttaccagtatcagaagaagactgtccgcaagatgatcttaaaggatcataaacgtccggatggacgtgccatcaaccagatccgtccgctggcagcagaggtggatctgatcccgagagtacacggctctgcgatgtttacacgtggacagacacagatctgcgatgtggtgacacttgcaccgctctccgaggttcagaagatcgacggactggatgagaatattacgacgaagagatacatccatcagtacaatttcccggcatattcggtaggcgagaccaaggtatcccgcggaccgggacgccgtgagatcggtcacggtgcgctcgctgagaaggcacttatggcagtgcttccttccgaggaggaattcccgtatgccatccgtgcagtgtccgagacattcgagtcgaacggatctacttccatggcgtcgacctgtgcgtcctgcatgtccttaatggctgccggagtaccgctcaaggctatggtggcaggtatttcctgcggtcttgtgaccggagataccgatgacgattacattgttctgacagatatccagggtctcgaggacttcttcggagatatggacttcaaggtaaccggtacgcacaagggtatcaccgccatccagatggatatcaagattcatggtctgaccagaccgatcgtagaggaagccatcgcaagaacaagagaggcgagaatctacattatggatgaggtaatgtccaaggcaatcgcagagccgcgcaagcaggtgagcgagtatgcaccgaagattgtccagatccagattgatccggagaagatcggcgatgtggttggacagagaggcaagacgatcaatgagatcattgcccgcaccggcgtgaagatcgacatcacagatgacggttccgtatccgtatgcggtacggaagcggagatgatggataaggccatcgagatgatccggattatcacgaccgatttcaaggagggacagatccttaccggaacggtagtgagcatcaaggagttcggcgcattcttagagtttgcaccgggtaaagaaggcatggttcacatcagcaagatcgcaaaggagcgcatcaaccatgtggaggatgtactgacccttggcgataaggtgaaggtggtatgccttggcaaggataagatgggaagaatcagcttctccatcaaagatgttccggcggaagcataaagcagtcatgcaccggtaattgcataacagaaatgaagtgccttttctatggctttgcataagctataagaaaaggcattttttatgaatcgggtcagaaaaatcatccatacggattatgcatataaaacaggtttgagcgggaaaaatgtaaccgtggcgattatggataccggaattgttccgcatgtggatttcgggaacaggatccgatattttggagatttctgtgaaggaaagacgggactgtacgacgacaacggccacggcacacatgtgtccggaatcgtggcgggcagtggcgaggcatcgagaaaagaatacgggatgccggtttgccacggcattgcaccgcaggcggatatcgtgatgttaaaggtgctagacgccaaggggaacggaaataccagggatgttctggcgggaatggagtggattgcaaagaaccagcaggaatatcagatccgcctgttgaatatttccgttggaatgcttccaagcgcgggagagcgggaacagcaggaacttcttagcgcggtggacgatctctgggacagggggatcatggttgtcgcggcagccggaaataacggccctaaggaaaattcggtgaccattcccggaatctcaagaaagattgtaacgattggaagcagtgacgacggaaagagcgagccggggaagcgggggcttaagacggggtacagcagcaacggtccgacggcatgctgtattgtaaagccggaaatcctggctccgggcacggcgattaaaagctgcggcagggaaaaaaacggataccgggtaaagagcgggacttccatggcggcgccggttgtcacgggtgcactggcgcttgcatttcagaagtatccgtatctgtcgccggcggagatgaagctgcgcttgtacgagagagcgtatccgcggggagagcagcttggcagaaaatgctggggaatgattcatgtcgaccatctggtgagaggctgaagaggagcgggaggctgaagaaaatagaatgctgcaagacggaaaggaagggaagggaagggaagggaaggggaggtgacgtgaccggcggttgacattttatatgaaaaaacgtaagataaaaaatacggttttgaaagggaggagacttatgaagaagattgcacaccttctgatgggaagactgacaattgtcggggtttcgatattgctgcagatctgctggctgtttctggtgctgtggaaattcagctatcagtttacctatgcgaacctgataatccgcgctgcggcgattgttctggtgcttgtgattgcgaacaagtgggagaatccggcgaataaactttcctggacgtttctgattctgttgtcgccgatccttggaatcatgctgtatttcctgtttggacgctccggtctgacgaagcacaccagagaacagatggatgccgtgaaccgggaagtggatgcctgcatgccggtagacgaggaggcggtcaggctgctgcaggaggcggatccatcggttttacgacagtcaaaatatattgcggactggggacattttccggtctaccggaataccgccacaaagtattatgagagcggggaggcgatgttcccggatatgcttgcagcgttggagagcgcggaacactttatttttctggagtatttcatcatcgaggagggacatatgttccaccagatcgaggatatcctggagaaaaaggtcaaagagggcgtggaggtacgcctgatctacgatgatgtcggctgcatcggcacactgccgccgcggtattataagcagcttcagaaaaagggcatcaagtgcgctgcctttaatccgttccggccgctgctctcggtaatcatgaacaaccgggatcaccggaagatttttgtggtggacggcgcggtcggttttacgggcgggatcaatctggcagatgaatatatcaatgaggtaaaacggttcggctactggaaggacaccggcgtgcgcatcgagggcgaggcggtctggagtctgaccagcatgtttttgtccatgtggaattacatcgtccattccacggaagattacagccggtttatgccggcacagcatcagaaagcaccctttgagaatgacgggttcgtgcagccgtacggtgacagccctctggatcatgagaatgtgggcgaaaatatttacctgaatatcataaacagggcaaagaattacgtctatatcttcacaccgtatctgatcattgaccatgagatgctgacggcgctctgcaacgcggcgaaggacggtgtggacgtgcggattgtgacgccggggattccggacaagaagatgattttcctgctcacgcagtcctactatgcaccgctcatacaaagcggggtaaaaatttatcagtacacgccgggatttattcacgcaaaatgttttgtctgtgacgatgagatcgcaacggtgggcagcgtgaatcttgacttccgcagcctatatctgcatttcgagtgcggcgttttcttctaccgctccgcggttgtggcacaggtaaaggaagactgcctgaatacgtttgcgtgctcagagcagatgacggcagagttctgcagaaaccggccggtaccggtacggcttctgcagagtgtgctacgcctgctggcaccgctattataatagaaaaaagtcaggtcagaagatagaaaagcgccatcttgaaataatcgcggtatgaggcggcgtgaacatccgcagtgtaacggatattcacggagccgagttccctgccgcctgcggagtagacaaccctgccggccacgtcaccctttctgacaggtgccgtgaccgtctcggggagaatctgctctttttttacatcagagaggtcctcgccttttacagacaggtaggagaagggagagtcgtaggcgagaccgacggcggtttcggtgccctttgtcacaggaagatcgggcagagcgtccgtgttttcatccgtgtacaggcggcattttccgaatccgtaatttaaaagcgtggtggcatctgcaaagcgcactttgtaatcgggcgctgccatgacgacggcgatcagttccagaccgtctttttctgcggtggcagacacgcagtatttggcgagactggtggaaccggtctttaatccggtggcatactcatactgccggatgagtttgttggtgttggtcagaccgaattccgaacttccctttgccgtgacatgggtgatgttttccatccagatggtgcagtagttgtggatttcgggatggtttacggtgagttcgcgggacataagggcgacgtcgtaggcgcttgtcatgtgcccttccgtatcgagaccacagcagttgacaaaggtggtgtctttcatgccgagccctctggcacgctcgttcatctgacggacgaattcggattcggaaccgcagagatattccgccatggcgacgcaggcatcgttggcgctcgcaacgctgatacatttgatcatggtctctacggtctgggtctccccaggctctaagaacacctgtgagccgcccatgcttgcagcgtattccgacacggtcaccgtgtcggtcagggagatctgtccgcgctctatggcatcgaaaatgagaatcagggtcatgatttttgtgatacttgcgggatgccggatttcatgtgcgtttttttcgtagaccacagttccggtggacgcctccatcagaagaacgctcggcgccgagacggaaaggtcggcttcgctgttttccgccgcaagaacgggagaagagagagtgagggtgcagcataacagaaaagaaagaaactgcttcaaggtattctccaggattctttttgttactattgtagaggaagaacctgtacattatgcagcgtgcacaaaaagaaattggcatcccgcgggaaactctcatttgaaacactaattatagtagagaagattgtgcgaaaatactaaatataggaaaaaaccttgaatttttcgaggaaacaatgtaaaattgatacgttgaagatgtggcagagaggttctgccgccggagaggataagagaatcagatggaaatgaccgtaaaactgcaggtatttgagggacctttagatctgcttttacacttgctcgagaagaataaagtaaatatctatgatattccgattgtggagatcacgaatcagtatatggaatacatcgcagagatgaagcgtcaggatctgaatgtggtaagcgaatttcttgtcatggcggcgacactcattgacatcaaatcccgcatgcttcttccggctccggagacggaggacgaggaagaagaggatccgcgtgcggaactggtacagcagcttttggagtacaagatgtacaaatgtatggcatacgagctgcgtgaccgccagatggatgcggagcgtgtcctttttaaggagccgaccattccgccggaggtggcagagtatgaggagccggtcaacatggaggagctcgtctcggatgtaacgcttgccagattgaatgagatttttaagtccatcatgaaaaagcaggtggacaagattgatccgatccgttccaagttcggcaagattgagaaggaagaggtatcgctttcggacaagatggcatatctggagaattactgcctgacgcacagccggttcagtttccgcagtctccttgaggcacaggcgggcaagatggagatcattgtcacgtttctcgccattctggaactgatgaagacaggcaagatatttatatcacaggaacacacctttgatgatattctgattcagtcaaagattgtggcatagagttggagttttcgggatgaatgaaaagaattacgaggcgatcattgaggcgatcctctttacgatgggagaatcggtagagctggacaagatcgccgcagccatagaactggataaaaaagagacaaaagcgatcattgagaagatgatgaagcactacgagaatccgtccatcggtgtgaagattattgagctggacgatgcgtatcagatgtgcaccaaaagcgagatgtacgaatatctgatcaagattgcgagacagccaaagcgccatgtcctgacggatgttcttctggagacgctgtccatcatcgcctataagcagccgatcaccaaggtggagatcgagaagatccgcggtgtttcctgcgatcacgcggtgaacaagctggtggaatacaatctggtatgcgagcttggcagactggatgcaccggggcgcccgctgctcttcggaacgacggaagagttcctacgaagctttggggtacagtcaatcgacgaactcccggtattaaatccggtgcaggtggaggaatttaagcaggaggcggaagccgagatgcatatgaagcttgatatatagaacataaaagaaatcctggtgcaaatctgtgagagacggataataaggaattgccgcaacaagcatagaccgctttgggtgataagtaatattatcagaagaccacaccgtgggatttcagatggaaatgcaggtggaaattcggttcaaaaaatgtggcatttctaaccaaccggatgtttgcatcttcgatgatccgtgtctttccaagtttggagcactccgcgggtcatgtccgcatcccggaagacaatttgtaggacttttgtgtgtgtcccttatggcacctctaagcaaaacataaccgcgcgaagccgatgtctgagtcggcatctgccttattttcaatagcagatgccggcgagtttcggttcgcgcggttttatattgtctgcgaagaggtgcccttagggacaccagaaagtccgcccattgtctccggtgtgccggacatgcacccgtcggattgtccaaacgtggaagagacacggaatccgatgcaaacattcagccggaagaaatgctcacatttttctccaacgaatattccatctgcatttccacatgaaatccccaagtgtgtttctaataatattacttatcaaagcacgatatgcttattgcggcagttcctttttacataccgtttctgttctgcaaaaaatgagggacgcatatacatcagtgaagtcattttgggagaatggcatgtatcgacgctttctttctctattgttaagtatgagcttgcttattttttcgcctgtgcgtgtccgggcgcaggatgtgccggcagagtcggaactgtacgcaaaatctgccgttttgatggatgcggattccggaagaattctctatgagaaaaacgggcatgaagcgatggcgaatgcgagtacgacaaagattttaacctgtatcgtggcactggaaaactgtgatccggcgagcgtggttacggtgtcaaaaaatgcggcgtcccagccgaaggtacatctggggatgcacgagggacaacagttttatctgagggatcttttatatggtctgatgctggaatcctacaatgactgtgcggtggccatcgcggaatttgcggcgggggaggtgcagggatttgccgcgctgatgaatgcgaaggcagaggaactcggctgtgaggacagctactttattacaccgaacggactggatgcgaaggatgatgccgggtttcatcacacgacggcggcagaccttgctaagattatgaaatattgtattaaggaatcgttaaaaagcgacgaatttctcgagattacacggacggcgcagtattctttttctgatgcagaggggaaatgcacgtaccagtgcacgaaccacaatgcatttttgcagatgatggaaggggcgctttccggaaaaacgggatttaccggaaccgccggatactgctatgtcggagcgctgcagcgggaggacaaaacgctgatcgtggcgctgctcgcctgtggatggccgaacaacaagacctataagtggtccgacaccagaaaactcatgaattacggattggagcagttcaaaaagatcgacctgctgcagattgagccggacgaagcggagcttgcgcccatagaggtgcgggacggacagggcggaaaaatcggcgaaacggtgtatttaaaactggttgtcaggaactatgcaggggaggagagtatcctggcgccgctaagcagtgaggttacgcttaggtatgagattgcagaccggctgtatgcaccggtgaagagcggagattacatcgggaagattcgttatatgctgggggaggagacgcttgcggagcgatgtgtggtagccggggagacaatcggaaagatcgattatccgtggtgtctggggcaggtgcttcggcttctctggatcgaataaaaaacacaaacaaaaagcgtcaaaaaattaacaatttacttgaaatattgcagaaaagcaattataatttaacatagcgtaatttgttgaatttttatacaaagacgcatggatttacatcattcactatgaagccgcatcccaaatggatgtggacaacaatttatagatggagggcaaaaagaatgaatagtagcaatgatagcctggctatgcagcgcatcaccaggttagtcgacgagaacagtttcattgagatcggttctctcgtaaccgcaagaagcacagattttaatcttgcagcaacggatactccttccgacggagtcatcacaggacacggcctgattgacggcaatctggtgttcatttacagccaggacgcttctgttttaaacggaacaatcggcgagatgcatgcgaagaagatcgctgcagtgtatgacatggcgatgaagatgggagcaccggtgatcggctttatcgattgcgcgggagtccgtttacaggagtctgtagatgcgcttgacggcttcggactgatctatgcaaaagaagttgcagcatccggcgtggttccgcagatttcagccgtattcggcagctgcggcggtggactggcagtggtaccggcactttctgattttgcttttatcgaagaatccaaaggaaagatgtttgtgaattctccgaacgcaattgacggaaaccgcatcgagaagtgcgacacatcatctgcggcattccaggcagatgagaacggctgcatcgacgcgacgggaacagaggatgagatccttgcagacatccgtgagctggtcggcatgcttccgctcaacaacgagggagatgtctacacagacgagtgtgcggatgacctgaaccgtgcatgcgagagcatggatgccatgaagggtgatccgagatatcttctcagtgagatttcggacagccatacattcttcgagacaaaggcaggctatgccagagacatggtgaccggatttatcaagttaaacggtatgacggtcggcgcagttgcaaactgcacaacggtatacgacgaagagggcaaagagagcgagaagtttgacaatgttctttccgcaaagggatgtgagaaggcagcagagttcgtatctttctgcgacgcattcgagatcccggtactgactctgacaaatgtcaagggctacaaggcatgcaagtgctctgaaaagcgtcttgcaaaggcacttgctcatctgacctccgcatttgcgggagctacatgtccgaaggtgaacctgatcacgggagaggcatacggtaccgcttatgttgctatgaattccaagtctatcggtgcggatttcgtatatgcatggccggacgcaaaggtcggcatgatggatgcggatcttgcagtaaagatcatgtacgcggatgcatctgcggatgagcttgcagagaaggcaaaggaatatgatgcactgcagggcagcgttatgacagcagccagaagaggctatgtggatctgatcgttgatccggcagatacgagaaagtatctggtagatgcgtttgaactgttatacacaaagtgtgcatatacaccggacaagaaacatggaacaaaatagaaaggtgaagtttatgaagaaaaaattatctcttatactttgtctttgctttatggctctgggacttgcagcatgcggaacagatccgacaacggttgactatttcggaatgacttacgatgaactgcagagcagcatggaacaggaagtttccgcgctggttggtcttacggacgacaacagaacctatatccagtcctacggcagcgatacggcaatgaaacttgtcgagagctgggatgaggcgacaagtgatgtcggcgcatatcagggacttggagaattcaatatcacaaaggcacagaaaaccttaacagtagatcagtatgtagagtatcagaatcgtgaagtcatcgtttcttacatctatacatacaattacgagaccgagcagccggagcttactgatgcatccgcggacaaggtatacacgctgggtgagaagatggagaaggctgcgttaaataccctgatgggaatgggaaccgtattcgtggttctgatcctgatcagccttattatttactgtttccgctttatctctgtaatacagaacaaggcggccggcaagggcaagaagaacgaggcagaggcaggcgctgtggtagagcagatcggacagcgtgaagagcagcttaccgatgatcttgaacttgtggcagttatttccgcagcggttgcggcaagcaccggtgcatccgcggattctttcgttgtgagatcgatccgcagacgctaattcgtataaatgaaaagaaatcatattaggaggatatttcaatgaaaagctatacaattacagtaaacggcaatgtatatgatgtaaccgtagaagagaacggcgcagtgagcgcaccggcagcagcaccgagacgtgcagcagcaccggcggcagcacctgcagcaaagccggctgctgctgcaggcgcaggcagcgttaagatcgaggcaggcgcagcaggaaaggtattcaaacttgagaagtctgtcggtgatgccgttaagaagggagacagcatcatggttcttgagatcatgaagatggagactccggtcgttgcaacgcaggacggtacggtagcaagtatcaacgtaagtgttggagatatggtagaagcgggcgcattacttgcaacattaaactaatttaggaggaagacaatgagctattttagtgagacaatggggaacctcctgcatcagaccgctttctttaaccttacctggggaaattttgtgatgatcattgtcgcatgctttttcctgtatctggctattgcgaaggggtttgagccattgcttcttgttccgattgcattcggtatgctgcttgtaaatatctatccggatatttttgcagacccggagcagatgagcaatggtgtaggtggtttattccactacttttatgtgttagacgagtggtcaatcttaccgtctctgattttccttggagtcggtgctatgacagatttcggaccgctgatcgcaaacccgatcagtttcctgcttggagctgcagctcagttcggtattttcggagcgtacttccttgcaatcatgatgggctttaatgataaggcagcagctgctgtttccattatcggtggagccgacggaccgacctccattttccttgccggaaagttaggacagtcgggactgatgggaccgatcgctgtggcggcatattcctatatggcacttgtgccgatcatccagccgccaattatgaagctgtttacaaccaaaaaagagcgtgccattaagatggagaacttaagaccggtttccaagctggagaagattctcttcccgatcgtggttacggtggttgtatgtacgattcttccgacgacagcgccgctggttggtatgctgatgctcggtaacctgttccgcgagagcggtgtggtccgccagctgaccgataccgcatccaacgcattgatgtacatcgtagttatcctgctcggtacttccgtaggtgcatctacgagtgcggaggcattcttaaatacaacgacattaaagatcgttgcacttggactgattgcatttatgttcggtacagcagccggtgtcctgtttggtaagctgttatgcttcctcacaaagggcaagatcaatcctctgatcggatctgccggtgtatctgccgttcctatggcagcccgtgtatcccagaaagtcggtgcagaggaagacccgacgaacttcctgctgatgcatgcgatgggaccgaacgttgccggcgttatcggtactgcagtagcagccggtgtattcatggcaattttcggaatttagtgaaagagcaaatgccgtcatagacggatagcggtatcaaagtatccgctgataaggaggaaaaaatgtcagaagttgttaaaaaacctttaaaaataacagagacggtgctgcgtgatgcgcaccagtccctgattgcgacaagaatgacaaccgagcagatgcttccgatcgtagacaagatggataaggtcggatacaatgcggttgagtgctggggcggtgctaccttcgatgcatgccttcgtttcctgaaagaagatccgtgggatcgtctccgcaagttaagagacggatttaagaacaccaagcttcagatgctgtttcgtggacagaacatcttaggatatcgtccgtatgcggatgatgtggtagagtatttcgtacagaaatcgatcgcaaacggtattgatatcattcgtattttcgactgcttaaacgatgtccgcaacctgcagacagccgttaccgcatgtaacaaagagaaaggacatgcacaggtcgcattatcctatacacttggcgatgcctacactctggattactggatggagatggcgaagaaagtagaggatatgggtgctgattccttatgtatcaaggatatggcaggtcttttggttccgacgaaggcaaccgagctgattcaggcattaaagtctgcaaccaaccttccgatcgaactccatacacactatacttccggtgtcgcttccatgacatacatgaaggcggttgaggcaggctgtgacattatcgatacagcaatgtctccgttctccatgggaaccagccagccggcaaccgaggttatggtagaggcattcaagggcacagagttcgataccggtctggatcagaacctgttagctgagatcgctgactacttccgtccgatgcgtgaggaagcgttagagagcggtctgatgaacccgaaggttctcggcgttaacatcaagactctgttatatcaggtaccgggtggtatgttatccaaccttctgtctcagttaaaagagcagggcaaggaagacaagttcgaggaggttcttgcagaggttccgcgtgtgcgtaaagacctcggtgagccgccacttgttacaccgtcctcacagatcgttggtacacaggctgtgttcaacgtactgatgggagagcgctacaaagtggcaaccaaggagaccaaagacgtactgcttggaaagtacggtcagactgtaaaaccgttcaacccggagatcgtagacaaggtacttggcgaggagaagaagaacgccattacctgccgtccggcagatctgcttgagccggagctggataagatcgaggctgagatgaagcagtggaagcagcaggatgaggatgtactgtcctacgcactgttcccgcaggttgcaaccgaattcttcaagtaccgtgaggcacagcagaagaaggtcgatgcaagcgtcgcagataccaagaacggagcatatccggtataatcaaaaaacagttataacaaaaagcgggtgagcagtcacctgctttttttgctgccttttttgctattttatcacaccgcaggcaatccgttcgccggagtcgcccgcgggctgcgttgtaaagttatccggcatccggtgaatgatgagggattttccgataatttccggaatcgtaaaacgcttgtcataaaatgccatccaggcataaccctggttgcccagaagcggaggcatgtcgccgctgtgattcgggtgtttggccggcgtacggctgtaatgggcaccggcactggtaaacggggagacgcatacgccgttttcgtggatgtgcatgccgtaaaaattactggagccgggagccgcgacgttcggaagaccgaagacttcaacctccacgagagttccttcgtattctgtggcatagaaccgggcaagcccggagatggaaggaaaattgttgccgccggcaatccaggcggatgcatccggcggagactgcatcagtgtatgaataaaattggttgctggtgtgatatcgcgcatagctgcctcaatggaagagtgtcgttggtttattatatgcagcggcagaaaaatgcgctgcatgtaaggaaagttccatgcataatttcttgcaaaacaccatgtatttgatataataaaaacattgagcggatcacaattccgcagaagtgaggagaagcatgagcaatacaaatgacctgagtaaccgcatcaatgatgcttacagtaagctgagcaagggacagaaacggctggcaacctacattacggacaattatgacaaggcggtatttctgaccgccgcaaagctgggtgaggttgtgggcgtgagcgagtccacggtggtacgctttgcgacacatctgggatataagggctatccggaattccagagtgcgctggaggaactggtgcgcaataagctgaactccattcagcgcatggaggttacttacggcaggatcagccagtcgaagattctggagacggtgctgaaatccgacgcggacaagatccattccacactggaaaagattgatcagaatgcatttgaactcgcggttgacacgatcctgcacgccaaacatatctatatcatcggaatccggagctgtgcgccgcttgccagcttcatggctttttattttaccctaatgtttccgaacgttcatctgattcagacaagcagttcgagcgagatttttgaacagatggtgcgcatcggcaaggaggatgtgatcatcggaatcagttttccgcgttattccatgcgtactttaaaggcgatggaatttgcgaataaccggagcgcaaaggtaatcacactcaccgacagcgtacattccccgatgaacctctattcttcctgcaatctgattgcggacagcgatatggcttccattgtggattccctggttgccccgctgtcggtgatcaatgcgctgattgtggcgctctgcatgaaaaagcagaacgaggtggcgaaaacgcttgagatgttagaggatatctgggacgaataccaggtttacgagaacgatgagatcaattatatcgatgattccatcaagatgcggtatggaaaagtaggagatgcggaactgtatgagtaaggtgatcgtagtcggcggcgggccggcgggaatgtttgctgccattgcggcggcggagcggggacatgaggtcgttttgctcgagaaaaatgaaaagcttgggaaaaagctctacatcaccggcaaagggcggtgcaacatcacgaatgcgggggatatggacaccctgtttgccaatgtgatgacgaacccaaagtttttgtacagcgctttttacgattatgacaatcagagagtgattgatttttttgaggagaatggtctggcgacgaaggtagagcgcggcaaccgtgtattcccggtatcggatcattcttcggatgtgatcgccacgctacagcgggtactaaagcgcacgggtgttatggtgcagcttcatgcggaagtgcggcagatcctcaccggggaaggcgcggtgcgcggcgtgaagcttgccgacggaagcgttcttgaagcagagcgcgtgattcttgcaaccggaggattttcttatcagacgaccggttcgaccggagacggctaccgttttgcgagggaactcggacatacggtgacacagattacgccgtcactggttccgttctacgtgaaggagacctgcgcggcgaggatgcaggggctggcgctgaaaaatgtgcaggtgcgcatccgggacggaaaaaagctgttgtatgacgaattcggcgagatgctctttacccatttcggggtaagcggaccgctgattttaagcgccagtgcggcaatcaagccgggccgcgtggagaaggaactggcgatggagatcgacttaaagccggcactcacggaggaacagctggatgcgagacttctgcgtgaattcgaggaggcaaagaataagcagtttaaaaacgccgtcgtgcatctgttcccggcgaagatgattccggtgatgttagaagccggagcgattgatccggagaagaaggtcaacgagatcacgagagaggagcggatgggatttgtgcatctgatcaaggcgtttccgctgacgctctgcggtgtcagagatttcaatgaagcgatcatcacacgcgggggtgtcagcgtaaaggaagtgaacccttccacgatggaatcaaagcttgtgccgggattgtatttctgcggggaactattggatctggatgcgatgaccggcggatttaatctgcagattgcctggtcgaccgggcatctggcgggtgagagtatcgaatagaagaggagagaagaagagatgagtatgaatattgcgattgacggaccggcaggcgccgggaagagcacaattgcgaaaaaactggcgaaaaagctggcgtttgtctatgtggatacgggagcaatgtaccgtgcgatggcatactattttttacagaacggcattgcaccagatgatgagcaggcgattgcggcagcctgcccgaaggttgacgtgacgattgtgtatgagaacggcgaacagcaggtgctcttaaacggagagaatgtaaacggcgtcattcggacggaggaagtcggcaatatggcatcagcgaccagtgtctatccggttgtgcgcacaaagcttgtggaactgcagcggcagcttgcgacaaagacggacgtcatcatggacggaagggatatcggcacctgtgtgcttccggatgcgcaggtaaaaatatatctcacggcaagcgttgcaacgcgcgcaaagcgcagatatgatgaactgaccgccaagggaacccagtgcaatctggaagagatcgagaaagatattgaagaccgcgattaccgcgatatgcaccgggagacgtcgccgttaaagcaggccaaggatgcggtgttagtggacagctccgagatgaacatcgacgaagtggtggacgcaatctatcagatttatgcgagggtatagagaatatgaatgtaatcttggcaaagagcgcgggcttctgcttcggggtaaaacgtgccgtggatacggtatatgaacggattttggaaaaagaaccgctctacacgttcggaccgatcatccacaatgaagaagtggtgcgtgatctggaggaaaagggcgtcgtcgtggtaaacgatgtggacgaacttgcggggaagccgcaggggacggtaatcatccgggcacacggcgtggagagaggtgtctgcgagaaaatacagacgctcggcttttccatcgtggacgcgacctgcccgtttgtgttaaagattcaccggctggtggagcgctacagtggggaggactgtcacattgtgatcgtcgggaatgccagccacccggaggtgaaaggcatcaaaagctggtcgaatgcagaggatacgcgcgtgatcggaacccgcgaagaggccgaaaaatacgatgcttcccatgggaaaaaggtatgtattgtatcacaaacgacatttaattacaataaatttcaagaattagttgaaattataaaagaaaaaggttatgatataattgttttaaatacaatctgcaatgctacggaggaacgtcagacggaagcccgggcaatcgcggagcaggtggatgccatgattgtgatcggtggcaggaacagttccaacacgcagaagctatttgaaatatgtaaaaacgaatgcaaaaatacttactatatacaaactgtaaaggatcttgaccttgccgaagtcaggtctgtcgataacgtaggtattaccgcaggggcttctaccccaaacaatattattgaggaggttcaaaagaatgtcagaaatgagctttgaacaaatgctggaagaatcatttaaaacaataagaaatggagaggtagttgagggtaccgttatcgatgtgaaacctgatgagatcgttctgaatatcggctacaaggcagacggaatcattactcgtaatgaatacacaaacgaagcaaacgtagaccttaccacattggtatccgtcggcgacaccatggaagcaaaggttttaaaggtaaatgacggtgagggtcaggtattactgacatacaagcgtctggctgccgagaagggaagcaagagattagaggaagcatttgagaacaaggaagtgctgaccgctaaggttgcacaggtactggatggaggattatgcgtaaacgtagatgagacaagagtatttattccggcaagtcttgtatcagatacctacgagaaggatctttccaaatacaaggatcaggagatcgagttcgttatcagcgagttcaatccgaagagaagaagaatcatcggcgacagaaagcagcttctggttgctaagaagttagagcagcagaaagaactgttcgcaagaatcaagatcggtgatgtattagagggaacagttaagaatgtaacagatttcggtgcgtttattgatcttggcggagcagacggtctgcttcatatttccgagatgtcctggggcagagtagagagcccaaagaaggtattcaaggtaggcgatcaggttcgcgtattcatcaaagatatcaatgagaataagattgcactcagcatgaagttcccggcagagaatccgtggaacggcgcagcagagaagttcgcaatcggcaacgttgtaaagggcaaagttgcaagaatgacagacttcggcgcatttgttgagcttgcaccgggtgtggatgcactccttcatgtatcccagatttccaaggagcatgtagagaagccgtccgacgtattaaaagttggacaggagatcgaggcaaagatcgttgatttcaacgaggaagagaagaagatcagtttatctatgaaggcactgctcgcaccggaagaagatgcggatgcagatgttgcagatgtagatattgatgcggttgcaaaggaagaggagtaatctctgatttcgatgattgcagagttacagataggcttgcacgttggtggaagcctatttctgtatttgcatcctgtagataacaaagagagtcgagggataaaatatgctggaaacggacaattatgaaaagtttaaaaaggatattttagcgcttgcaaagattgatctgaattcttataaggaaaagcagatgcggcgcagaatcaacacgctgattacgaagaatcatattgcgacatatgatgagtatgtggcgctgatcaagaaggacaaagagaagtttgaacagtttatcaatttcctgaccatcaatgtgtcggagttttaccgcaatccggatcagtggaagattctggagaatgaggtgttcccgaagctgattcagaagtttggcaagaatctgaaaatctggagtgctgcctgctcgaccggagatgagccgtattcgctggtaatggcattgtccagacacctgccgcttgcaaacatcaaggtgattgcgaccgacattgacaagcaggtgatcgatacggcgcggatgggactctacaatgagaagagtatcgcgagtgtgccggatgatttgaagaagaagtattttaccaaggtcggcaattcgtatcagatctcggatgagatcaagaaacgtgtggaattcaaggagcatgatcttttaaaagatccgtatccaggcggatgcaatctgattgtgtgccggaacgttgtgatctattttaccgaggaggcaaaggacgagatttatgcgaagttttataaggcgcttgcaacaggcggcgtgcttttcatcggaagcacggagcagatcatgaattaccgggagatcggatttgagagagacaagtcctttttctttgagaaggcgtaaggttatatcagaggacgcatttttctataaagcaaaaaagcggcaggaaagaagctgtgcagtatatgccagattctttcctgccgtttttggtggtaattatatcagggctttctgccatgtgtttatttgcggtgggaacgcatggtttctaacagatgcagaacatagtccatctgcatagcgggatcggcggcaaagtccgcggataattcaaaatagcatttcctgccgcgcggctgttcacggaacaccggggaaaacatggcgtcatactgcggaagaaagatggcatattttttgccgtagcagttggaagcgttcgcctgcacgcggtgttctttgtcgacggcggatgcaatactcttgtgaactgcgatatcctccgcagggagatagtagtaatctttgggactgccgtcataaaagaagcgcagttctccctcgaagagacgtacacgcagccgggcggtacttccgctcatggagagataacagtcatcgtaggagaaggagaccggtttgggaacggggtactgcagcgccagtgtaaaaaacagctccttgttgccggaggcaccgtccatcgaccggtactcggacgcctggagtgactgcagagaaaatgcctgttcccagagttttgggtaggagaggacgggcagaagcttcggcatatagagaacgtcctcatagttgtgctgtttcagcagtgcaagggaatcctttgcgggatgccgcacgtactctttgtagacttcgatcagctcgccgccggagtaggcgtcgatgcggtcaatcccgagaaacagttcgatggatttctgcttgtagctggtcagggcaaacagaaatttgaaacgtgagacttccttataaagatcgatataactgtgcgcatcaaacggatcggaaaggtgcagcgccttgcatttcgccttcaggtatggaatgtcgaagccgataccgttgaacgtcagaatggtatcatagccggacaagagctccagaaaggcggaaaggacatttttctgatcggcggcgttctcggaaaagaactggtcgatgcacaaaagactgtcgcgccttgtggcgcagccgatcaggtagagatccgtgcgcgccggcgagaagccggttgtctcaatatcaaaaaaaatgcagttttctgtaaatacctcgttggaaacggggtctgaaaaatcaaaagtcagttcttcatgccaggttatcatctgaaaatcctctgtatgtaatattagggtaagagttccaattttgccgctgtgcaggtctggaaaggcatagatttcccggactcgcgggcgttcgcggcaaatagcaatgtacgctccggcaaaagcccggaaagcctgcggcttcccggactcgcgggcgttcgcggcaaatagcaatgtacgctccggcaaaagtccggaaagcctgcggcttcccggactcgcgggcgttcgccctatcaaaatcgtaccagccaaaatatacactgcaagcaggtaattttgccagatacgattttggcactgctcattgccttcgcgtacattataacataaatgtggaaaaaatattgtgaattctttgtcaataggttcgtgaaaaaatacaataaattgctacaatttccgagtgattgtgctataatctacacgagggtattctatgacttttggcatagaatataatatagataagagaaagtggggcacgagaaatgggttctaagacatttaaaggcggcgtccatccttatgaaggaaaggaactggcaaaggatcagccgatcgtagaagttctacctaagggtgatctggtatacccgttgtcacagcatatcggtgcaccggcgactccggtggtagcggttggtgacaaggtgctgaaaggacagaagatcgcagaggcaggtggctttgtgtcatccccgatctatgcgtcggcatccggtacagtaaaggcaatcgaaccgcaccgtgtggcagtcggtgacatggtgaattccatcgtcattgagaacgacggggcgtttgaagaggtggagtacacgccgtgtgaagacgtgacggctctctccaaggaggagattgtcaataaggtaaaagaggcaggcgttgtcggcatgggcggtgcaggtttcccgacacatgtgaagctgtctccgaaagagccggaaaagattgaatatgtaattgcaaactgcgcagagtgtgagccgtatctgacggcggactaccgcagaatgctcgaaaatccggaagagctgatcggtggaatgaagatcattctccagctgttcgatcatgcgaagggtgttctcggcatcgaggacaacaagccggattgtattgaaaagctgacagagcttgtcaaggatgaaccgagaattgaggtctgtcctttacagaccaagtacccgcagggtggtgagcgtcagctcatttatgcagtgacaggccgcgccatcaattccaagatgcttccggcagatgcaggatgtatcgtggataatgtggagaccatcattgctgtttaccgtgcggtaaagcttggcagaccggtaaccaatcgtatttctacgattacaggcgatgccattgccaacccgggcaacttcttatacagcatcggtaccagctatgcagaactggtggaggctgccggcggatttaagacacagccggagaagattatttccggtggtccgatgatgggatttgcaatgtttagcctggatattcccacgacaaagacatcttcctcactgctttgcttaagcaaggacgaagtgtccaaggtggagccgtccgcatgtatcaactgcggccgctgtgtggaagcatgcccggagcagctgattccgtcaagacttgccaagttttccaataacggtctggctgaggcgtttgaatcctggcacggactcgagtgcgtggagtgcggaagctgcagttttgtatgccctgcacgcagacagctcgcacagtccattaagacgatgaaaaagcaggtacttgctgcaaaacgcaaaaaataattcaaaaaacaagaagagagaggtggattatcgtgagtgatttatatcatgtttcatcatcaccacacgttcgtgccaaagataccacaagccgtattatgctgtatgtgattattgcattgcttccgacaagcctgttcggtatttacaatttcggatataaggcattggttctgattctggtaacgatcgcaagctgtgtggcatcagagtgggtatttaataagattgtacataaaaagcagacgatcgatgacctgagcgccgttgtaacgggactgcttctggcattgaaccttccggcaacccttccgtggtgggaggcggtaatcggcggtgtgtttgcaatcgtggttgtaaaatgtctgtttggcggactgggacagaatttcatgaacccggcgctgggcgcaagatgcttccttttgattgcatttgctgctgatatgacaaagttcggcatcacaaagaacggtattgaagtgtattccagcgtaacaccgcttgctgccatgcgtaacggtgaggcggtcaatacgatggatatgctgatcggacgcaccgcaggtaccattggtgagacatctgcgatcgctatcctgatcggagctattttcctgattctgatgggtgtgatcaaccttcgcatcccggcatcttacattattacatttgctgtattcatgcttttattcggcggtcatggatttgacggcagctatcttaccgcacagctttgcggcggcggtctgatgctcggcgcattcttcatggcaacggattatgtgacatccccgattacaccgatggggcagatcatctttggtatctgctgcggtatcctgaccggattgttccgctgcttcggcgcgaatgcagagggtgtttccttcgccatcatcttaagcaatatccttgtgccgcttattgagaagcacacggtgccgatggcattcggtcaggtgaaggaagcgaagaagcaggaaggaggcaaatagaaatgaacaagaagattgtacatgacgcattggttttatttgcttttactgttgtattaggtctgatcctcggcgtggtctacggcattaccaaaggcccgatcgaccaggtaaattatgagaagacacagtccgcttacaagcaggtatttgaggatgcggattcctttgaggagtacgctgatttcgacaccgctgcagcggaagatcttatggcgcagaatggatattctgacgatatcgaggctgtcaacacagcacttgacgcttccggcaatccgctcggctatgtgcttaccgtaacggcgaaggacggaagccagggcagcattacattctctgtcggcatccagaatgacggtacggtcaacggttattccatcacaagtatttccgagacaccgggacttggtatgaaagcacaggaagagccgttctacagccagtttgagggcaagaacgtagactcctttacggttgtgaagtcgacaccgtctgcggacaatgagatcgaggcaatttccggttccaccattacttccaaggcgatggcgaacggtgtgaatgcctgccttacatacttccacagcgtattagaaggaggtaactaatcaatgaacaagaatgtagaacgtttatataatggactcattaaggaaaatcctactttcgttctgatgcttggtatgtgtccgacacttgctgtcacatcctccgcaatcaacggacttggtatgggactttccacaacagtggtactggtactttccaatatgctgatttccgcattccgtaaggtgattccggacggtgtgcgtatgccggcatacattgttatcgttgcatcgctggtaacagtggtgcagtttatcatgcaggcgtataccccgagcctctccgagtcgctgggtgtgtatatcccgttaatcgttgtaaactgtattatcctcggccgtgctgagagctatgcttccaagaatccggtagttccgtctcttttcgatggacttggtatgggacttggatttacgatgggtcttaccctgatcggactgttccgtgagcttctgggcgcaggtcagatctttggtttccagattctgtccttaagctggttcacaccgatcaccatctttgttatggcaccgggagcattcctagtactggcatgtctggtagctgtgatgaagatcgtccgtgagaagatggcagccaagggcaagccgcttgccgagccgtccggatgtatcaccggagactgtgcaggatgcagtatgtctgctgcatgcaccggtaagaaaccggcagcggaaactccggcagaaaaagcagaataggaggatagatacggatgaaaacattacttttaattgcaatcggctctgccattgtcaataacgttgtattaagtcagttccttggtatctgtccgtttttaggcgtttccaagaaaacagagaccgctgccggaatgggtggcgcagttgtattcgttatcacgatctcttcgttcgtgacagcgctgatctacaaatatatccttgccaacagctatctgatgagcaagggcattgaccttacctacctgcagacgattgtatttattcttgtaattgctgcactggtacagttcgttgagatgttcttgaagaagtccatgccggcattataccagagccttggtgtataccttccgctgattacgacaaactgtgccgttctcggtgttgcactgacgaatgttaccaaggaatacggtattttggagagcgtggtaaacggttttgcaaccgcatttggtttcctgattgcgatcgttttaatggcaggtgtgcgtgagaagatcgagtacaatgatatcccgaagccgtttcagggtactgcaatcgtattgatttccgcatgtctgatgtcaatcgcattcatgggattctcaggaatgatttaggaggaaaaagaagatgaacgttacagcaattttatttgcagccttaatcgtgggcggcgtaggtatcttgattggatttttccttggtatttccggagaaaagttcaaggtagaggtagatgaaaaagaggaagcaatcttaggtgtgcttccgggaaataactgtggtggctgtggttatgccggttgttccggtctggcagcagcaatcgcaaagggcgaggctccggtcaatcagtgtccggtcggcggcgcgccggttgcagccaagatcggtgagatcatgggtgtggcagccgaggaaggcgagcgcaaggtagcatttgtaaagtgtgcgggaacctgtgagaaggcaggacgcgattacgagtataccggcaacgaggactgtgcagccatggcattcgtgccgaacggcggaccgaagtcctgtaattacggatgccttggatacggtagctgtgtaaaggcttgtccgtttgatgcgattcatatcgtggacggcattgcgcaggttgacaaggaagtatgtaaggcatgtggaaaatgtgttgctgcatgtccgaagcatctgatcgagcttgttccttacaaggcaaagcacattgtacagtgcagctccaaggataagggcaaggatgtcatgaaggcatgttccgttggatgtatcggatgtcatttgtgtgagaagaactgcccgaaggatgcagttcatgtcattgacaacgtggcatacattgatcaggagaagtgtgtcggatgcggtatttgtgcacagaagtgtccaaagaaaattattttgtaagaatcattttctccgaaaatcattctgtaagaatcgtttcttggaatgaaagtgtgaaataaaaacaggcgtgaagaattcgcggtaataagtacgaattcttcacgcctgttttgttgtttaatcttccagaatctcatagggaatgacggttcccatgccggagctggtgtgtacttcatagtcgtctgtgatgaaaatagcttccgtagcatcaaggctttcaacgagcgccataccgtcttccagcccgagggagaaacaggtggtggagagaccgtcgccgtccaccgatgcaccggtgatgatcgtgacctcaaggagcccgttatcgtaagggtaaccggtcgcggtgtccaggatatggtgataacgcgtcccatctacttcaaaatagcgttcgtagacgccggaggatacgacggtctgatcggtgatggagacggaggcaatcgcttcgttttcctcaccaaacggacgctgtatgccgatggtgtatgccgaaccgtccgtcttcgcgccgagcgcaagcacatttccgccgagattgatgtaaccggaagtaattcccttctggttcaggtaggctttcatctgatccgcgatatagcctttggcgatgccgcccagatcaatcctggcatcgggattttgcagagtcactgtgttgccgtcaatctgaatctcccggtaatccactgtggcaagagccgcctgaatgtccgtgtcggaggggatcatggagacatcggtctgatcaagcagcgctttggttgagatgtcccacagatcggaaagccgaccgatggtgatgtcgaatttgccgccgcttaagtcgccatatgagatgccggttttaagaagttcgatcgtctcgtcgtgtactgtcacgggagcgccgcccgcatcgttgattttggaaatatcgctgtctggaatcgtattggaaaaatatccctcgtacttttgcgcaagggcaaaacagtcatcgagcagttcctcgctccctttttcatagatcgagaccgagatgacagtgttaaaataaaatcctgacttggtaaccggttcgtccgccgtgcggctgcagccggagagcagcagatttgcagagagcaggggaaccagaagacaggagagtaccttcttttttctcatcataaaaatctccatttctgatgtttcccatccaatgtaccataaactttctgttcatacaatgtgaaaacatcaatttgccattttgatgaagatatgatagagtaatacagtatgagactctatgcccatttgggatgaatgattggaaaatgttacatataaaggggacgttagacagatggaacaaaagcattttcattttaatgagaaaaagagagttgtagtcaagatcggatcttcctcattgaattacggggagacaggcaatctgaattttaccaagctggagcatctggtaagagaactctgcaatctgcggaaccgcgggatggatgtgtgtctggtaagctccggcgcgattgccgtgggcagacagacgctcggcatggatgagcggccgaaggacatttcgacaaagcaggcatgcgcggcggtcggccaggcgcggctgatgatgatctatcagcggctttttgcggaatacaatcaggtggcagggcaggtgctgatgacgaagaacacgatggtgaaccctgtctcgagagagaatgcgaagaatacgttcgacgaattgttccgtcttggcgcaattccgattgtgaatgaaaatgatacggtttctacttatgagatgcagtttggcgacaacgacacgctctcggcaatcgtggcttctctgatcggggcggatcttttgatcctgctctcggatatcgatgggctttttaccgacgatccgcacaagaatccggatgcaaagctcattgaagtggtggaggagatggatgcgtcaatctacggcatggcgaaaagttcgaccggcagtgatgttggaaccggcggcatggcgaccaaactgacagccgcaaagattgcaacgctctcgggaacagacatgattattgcgaacggcagggatgtctgcattctgcatcatatatttgatgattcctttaagggaaccatttttcaggcaaagaagaaagaatctttccggattgaagattttattttggagacgatcggttaagaatacaggaaaaggagtactatgaaccaggaacagattgacagaatcaatgcgttatatcgcaagtcgaaggcggaagggttgacggaggaagaaaaaaaggagcaggcgctgctgcgcaagcagtatgttgcggatgtgaagaaaaatctggcggcgcagcttaacaatatcgatatggtgaatccggacggttccgtggagaaccttggagataagtatggaaaaaagacaggactttcctgacgcagcgctgacacaggagaaggcgcgtcagcagataagggcgcggcacaaagcatggcggatggaactgccgcaggaggaagtgcaggaaaagagcagaaagatctgtgagaggctggcggcgtctgactggtatcataacagcgctgtcatctacggctattatccgctcggcgcggaggctgactgtctgccgtttctggcacaggcactttcggacggcaagacggtggcgcttccggttacatcaaaagagcggttgcagcgggactgcggccaggtgaagagaatgcaggacacacaccggatggagttttaccggatcagagagctttccagggtgcgggagggcgcctttcatgtgatggagccggatgagagctgcaaacggatcgggggagaggatgcggtggtgctggtgcccggactggtctttgaccgtaaggggaaccggtacgggtatggcggcggttattatgaccgctattttgcaaggtttccgaagctgtcccgcatggcggtagcgtttgaagggcagatcgaggaacagcttgcggtgcttcccaccgacgtgcggatgcatcggatttatacggaggagcgggaatatcggatctgacagaaaggatggaaaggatatggaactgacagaactttgtaagagcgcaaaagaagtgagcagacagatcggcaatctggacacgaatacgaagaacgaggtgttgcgtgcagcggcagaggcaattgtggcacatactgaagagattatccgcgagaatgagaaggatctcgcccgcggcagagagaatcatatgcccgaaggactgctggaccgtctgatgctcaacccatcccggctggagcagatggcggagggactgcggcaggttgcagaactttctgatccgatcggcgaagtcctttccatgaagaagcgcccgaacggtcttatgatcggtaaaaagcgcgtcccgctcggtgtggtcgggatgatctatgaggcgagaccgaatgtgacggtggatgcgtttgcgctgtgttttaagacgggcaacgcagtgatcttaaaaggcggcagtgacgccatttcgtccaatatcgtcattgtttcggttctgcaggaagttttggaggcacatggcattccacgtgcggcagtatcgctgattgaagatacaagccgggagacggcggctgcgttcatgaagatgaacgaatatgtggatgtgctgattccgcgcggaggagcagggctgatccgcgccgtcgtcaatcaggcgacgattcctgtgattgagacgggaaccggcaactgtcatatctatgtggatgagagtgcggatttcgatatggcaatccgtattattttaaacgcaaagacccagcggatcggtgtgtgcaatgcctgtgaatcactcgtgatccatgagaaaatcgtggatgcatttatgccaaagcttgcggcggcactgcagcagaaggatgttgttatttatgcggatgagaaaagtcttgcagcggcagagcgccgggaggcggcaaatgacggagacctgaaaaaggaactgttgtcggcggcgacggaggaagactggggcagggagtatctcgattatatgatctccgtgaagacggtgtcgtccctcgacgaggcgatcgcacacatcaaccgctacaataccgggcattcggaggcaatcatcacagaaaactacacgaacgcgcagcggttcctggatgagatcgatgctgcctgcgtctatgtcaacgcatcgacgcgtttttcagacggatttgaatttggatttggcgcggagatcggcatcagtacccagaagcttcatgcaagaggaccgatgggactggatgcgctgaccagcacaaaatatattatatatggaaacgggcagacacgtccgtagatggtaaggatgaagatgaaaaagaaaatagacattgaaataatcgataaaaagcagatcccgcagagcgagccggagcgtcagtattactttatggacattgctaaaaattatgtggaacagctcgctgcaaaaaaaggcagtccgctgacctttcatgtcacgacgttcggctgccagatgaacgcgcgcgattctgagaagcttgtcggtatcttagagcgcatcggttatgtggagacggatacggaggaagcggattttgttatttacaatacctgcacggtgcgtgaaaatgcaaataacaaagtctacggaagactcggggtactccagaattataaaaagaaaaatccacatatgctgatcggactctgcggctgcatgatgcaggagacggtagttgttgaaaaattaaaagaaagctaccgctttgtggatctgatcttcggaacacataatatctacaaatttgcagagctgatcgtgacggcgatggaatcggattccatgacgattgatatctggaaggacacggaccagattgtggaggatctcccggtagagcggaagtattcgtttaaatctggcgtcaatatcatgttcggatgcaataatttctgcagctactgtatcgtgccgtatgtgcgcggaagggagcgcagcagggagccgaaagagatcatccgtgagatcgaacagctcgtggcggacggcgttgtcgaggtcatgctgctcggacagaatgtcaattcctacggcaagaatctgaaggagccggtgacgtttgcgcagcttttagaggaagtggagaagattgaggggttagagcgtatccgttttatgacctcccacccgaaggatctctcggacgagctgatcgaggtgatgggacgatccaaaaagatctgcaaacatctgcacctgccattacagtccgggagcagccggatcttaaagatcatgaaccgcagatatgataaggaacattatctggaactggtggacaagatccgcgcggcagtgccggacattgcgctgacgacggatattatcgtgggattcccgggggagacggaggaggacttcgaggagacgatggacgtggtgcgaaaagtgcgttatgacagcgcgttcacgtttatctattccaaacgtaccgggacaccggcggcatccatggaagagcaggtgccggaggatgtgatcaaggcgcgttttgaccgcctgcttaaggaagtgcagaagatctccgcagaaaaagcggaggcgctgaccggacagacgctgccggtgctgattgaagagcaaaacgagcaggatgcttcgcttgtgacgggaagactcagcaataactcggtggtacatctgccggggacagcggacatgatcggaaagattctggatgtaaagctgaccgagtgccggggcttttattaccttggcgagcgggcagacggaaatggtcagacggtatgaaaaagcgaatcagcagaaacgatgtgatttttcttgcaatactgcttgccgtggttacggtatttcttgtgatctatgagcggacgggaatgcgcgcggatgcgggtgcctgtgtgcgcgtcaccgtggacggcagcgtgtacgggacctatgcgctcggggaggagcaggagataccgattgtgcaggacggcgtgacaacgaatgtcctgacaatccgcgatggcagggcggacatgacggaggcggactgcccggacaagctgtgtgtccatcagaaggcaatctctaagaatcatgagatgattgtctgtctgccgaacaaagtggttgtggaggtgacgggaagtgaagaaaacggattcgactccattgcgagataaggtggcgtatctcggggtttttcttgcgcttgccttaatctgcagctatgtggaatccctgatcccgttttatttcggaataccgggggtaaagctggggctcaccaatattgtggtggtactgatgctgtactgtgtcggcactaaggaggcgtttgccatctcgatgctccggattgtactggcgggttttctgtttggcaatctgttcagtatcttatacagccttgccggcggaatgttcagctttctggtaatgtatcttttgaaacggaccggaaagctcggtgtgctgccggtcagcgtcgcgggcggaatgtcacacaacatcggtcagattgccgtggcggcgtttgtggtggagaatatcaacattttttactatctgccggtgcttttcgtggcaggcatcgttacgggactgctgatcggtgtggcagcccaggagatcatactaaggattggcggacggctgaaacgataaggaggaaatacgtgtgtacgcatatataaaaggcgtccttgcggatgtggaagaagagagcgtggttgtggaggcaggcggaatcggataccggatctatacgaccgggcagacgtttgactatcttccggctgtgggagaggaagtcaagctctatacgtatctgaatgtgcgcgaagatgcgatgattctgtacgggttcctgacgaaggatgacctgcgtgtcttcaagctgttaatcggcgtcaacggtatcggcccgaagggggcgctggcggtgctgtctgtgatgacaaccgatgatctgcgatttgcggtgcttggcgatgacgcgaaggcgatcgccaaagcgcccggaatcggtgcaaagacggcacagcgtgtgattttagaactgaaggacaagctgtcgcttgaggaggcgtttgaactcaaatccgagcatgtgagcagacagaacgagaacggaagcagcggtgtgaagaatgaggcggtgcaggcgcttgtggcgctcggctatgcctcttcggaagcgttaaaggcgttaaacggcattgagatcacggatgatatggatgtggaaacactgttaaaagccgcgcttaagaatatggcattcctgtagtaagggaagcggcaaggcggaagaaaggaaagctgggacatggagaagcgggtcatatccacgcaggtgcaggaggaagatcttaagatcgagaaaagtctccggccgcagacgctggacgattatatcggacagcagaaggcaaaggaaaatttaaaaatatatatcgaggcggcaaaggcgaggggggaatctctcgaccatgtgctgttctacggaccgcccggacttggaaagaccacgctcgccggaatcattgccaatgagatgggaacacatatgaaggtcacttcgggacctgccatcggaaaaccgggggaaatggcagcgatcctaagcaatctgcaggagggagatgtcctctttgtcgacgagatccaccggctgaaccgccaggtggaggaggtgctgtacccggcaatggaggattatgccattgatatcatgcttggcaagggagccacagcgcgctccatccgtctggatctgccgaagtttaccctggtgggagcgaccacgcgcgcgggacttttgtcggcaccgttaagagaccgttttggcgtggtgcatcatctggagttctacacggtggaggagttaaaaacgatcatcctgcattcggcattgacacttggggtggagatcgatgaggagggtgcttacgagatggcgagacgctcgcgcggaaccccgcgtctggcgaaccggctgttaaagcgcgtgcgcgatttcgcgcaggtaaaatacgacggccggatttcaaaggaggtagcgtcctttgcactggatctgctggaggttgacaagatggggctcgatcagaatgacaggaacattttgatgacgatgatcggaaaatttgcgggcggaccggtcgggctggacacgctggcggcagcaatcggtgaggatgccggaaccatcgaggacgtatatgaaccgtatctggtaaagaacgggctgatcaaccgcacgccgaagggacgggtggtgacagagctggcataccagcatctgggaatcgaacattccgtatagaaatagttgcttttccttaaatatgtcagtataatatactatatattgtagcggatacccgagtttggaggaaatggtatggcagagaagacaagcgccgaagtgatcatcggtggaaaggtatacacactgagcggttatgagggcgaggagtacctacagaaggttgccacctatatcaacaataagctgggcgagtttcagggcatggaagagttaagacatctatccggcgacatgaaggcgacgctgttgcagttaaatatcgcggatgattactttaaggcgaagacacaggtggagaagcttgagcgtgagatcgagcagaaggaaaaggaaatctacgatctcaaacatgatcttatttccaatcagatcaaggcagagagcgacgagaaagccagaaaagagctcgaggagcagaacaaggagcttttaatcaacaaggctaagctggaggcgagtctcgaggatgcgctgctcggcaaagtaccggaaaaagataaaacagaagaatagacaatacggggacgtaagagatttgctttcgtcccttattttcatataacaggtaagaaaaatgatgcagaaaagagaattggagctgctggctccggcgggatcatacgagacgtttgaggcggtcatacgggcgggggcggacgcggtatatctgggcggcagccattttggagcccgcgcatatgcgaataattttaatgaggaagaattgctgcgtgccatcgactatgcacatatccatggcagacaggtgtatctgacggtgaacaccctgttcaaggaggaggaactggaacagggactctatgagtatctgctgccgtattacgagcaggggctcgatgcggtgatcgtgcaggatatgggggcgtttgcaaggatacgaagcatgttccccgggatggatattcacaccagcacgcagatgactgtgaccggcgcggcgggtgcggcgtacatgaagcagctcggtgcgagccgggtggtcatggcgcgggagatgtcgtttgccgagataagagaaatccatgacaaggtgggaatcgagatcgagagttttgtgcacggtgcactgtgttactgttattccgggcaatgtctgctcagcagtatgctgggcggcagaagcggcaaccgtgggcgctgtgcacagccgtgccggcttccctatgaggtctacaaaaaggatcagaaatcccgtatcgcgtgcggcaattacgtgttaagcccgaaggatctgtgtacgattgatgccattcccgcacttgcagagagcggcatattctcctttaagattgagggacggatgaagcaggcggagtatgcggcaggcgttgtatccgtttaccggcagtatatggaccgttatctggaccggctgaatgaggagagagcgggcggctgcagcgaggatgaggcacgccggcgggcgaagaaggcttacgcggtaacggaggaggatcacagaaagctgctggcgctcggcaaccgcagcggttttaccgacgggtactatttccgcagaaatggcagggagatgattacctttgattccccgggacatgcgaagacagacgaggcactgcagaagacggtgcgggaacactatatcaaagtgcggccggagcaggaaatcaaagaaaaaatcaatggattcttaagattaaaaaaagatttatctgctacactgaaactgcaatgtgaagaatgtgagattacgtgtgagggggagcaggtattgcaggcgcagaaacagccgctctcgcgtgacagggtggacgtctgtatgagaaaaacaggaaatacaccgtttgcatttgaacagctggccattgagatggacgaggatgtttttctgccggtgcaggcactaaacgcgctgcgtagggaggcacttcttgcactggaggagaagcttctgcagggataccgcagggatggagcagcgtccccggaggcggagaagttaggctgtggcgcggacaaaaggacgcggcaggaggagcgaagagaagcagaggatgccggtaaaacggtcatcgtttcgttggagaaccggtgtctgctgccggtggtgcttcgttcttcctttgtacatgggatttatgtggacagcagctgctataccagggatgaattatggacggcacttttaaaagatgcaggagaggcacacctggcgggaaagaaattctattatattctgccggcggtatttcgcagcagaacggcagcattttacagggagaatatagagcacttaaaggcattgccgctggacggatttgtggcaaaaagttacgatgccgccgcatttgtgcggcaggagctgggtgcggagacgccgttaattttagatcacagtctctatagctggaacagtgcagcgcgggatgtgtttttgcagcttgcaccagagcgcgataccgtaccgcttgaactcaaccggagcgaactgtttgcgagagacaatcatcacagcgaggcgatggtgtacggttatcttccactgatgacatccgcgcagtgcgtgcatgcgaacacggagaagtgtgataggaagcgcggaatcttatatctgaaggatcggtatggaaaatatttcccggtcaaaaataactgcacggagtgttataatacgatctataataccacgccgctcatgctttttgacgaacgcgcggattttttacgcatgggaattgccgcataccggatatcgtttacgattgaggaggaagagcaggcagctttcatactggatctttttgagcggacgttcctttccggaaaacacagcgtaaaggaactgtttcccgacggctacacgaggggacattataaacgaggggtcgaataaccaatgacagatttgattgtagaattatcaaaatatctcatgacacttttgttcgcgttctatacgtacgagtgtttttcctcattccgcgggaagcttaccccggagaaaagggcgaagatatttaagcgtcagatgtgcctgatgtatctcattcatctggatgcgtttctggcaatctacgcggtgacggacgatatccgcatgattttgttctatgtggtgcaggcggcgtttattgccgtcacaatttccagttaccgcctggtgtacggaagggcttccgggcttttgatcaacaatatgtgcatgctgttaatgatcgggtttattatgattacaaggctttcctttgacaaggcgatccggcagtttgccattgcggtgggggcgatggtgtgttcgctcattataccggtgctgattcagaaagtgcgctttttgcggaaaatgccgtggctttacgcagctgccgggatcatcggtcttctggcggttctggcgttcggaatcacgagcagcggtgcgaaaatatcaatctcgcttgccggaatatcggttcagccgagtgaatttgtcaagatcatatttgtattttttgtggcatgtatgctttacgagaatacggatttgaagcacgtgtgcatcgcgacggtgctggcagcggtgcatgtcctgattctggtgttatcgagagatctgggaggagcactgatcttctttgtgacctacctggtgatgctctatgtggcgaccagaaagctgttctattttgcgggaggacttctgaccggatgtattgccgcggtggtggcatatcagctgttttcccacgtgcgcgtgcgtgtcctggcatggcaggatccgctctcaagaattgagaatgagggctaccagatctgccagtccctgttcgccatcggtaccggcggctggtttggaatgggactataccaggggatgccggaaaagattccggtggtcgagcaggactttatcttttccgccattgcggaggagatgggcggcatttttgcaatctgtcttttgatggtgtgcatcagctgctttttgatgttttttaacgtggcgatgcagatgaaggagcagttttacaagctgattgcgctgggactgggaaccgtatacggatttcaggtgttcctcaccgtcgggggagtcacaaaatttattccgtcgacaggagtcacgcttccgcttgtcagctacggaggaagctcgctattttcaacgatgatcatgtttgccgttgtgcagggcttatacatcagacggcaggatgagggggcagcaaatgaaagaaaaaatgcagcaccgccaagacgaagaaaaacaggatttgacgaagatgtggaaactttttcataaaaacggaaagaaaaaaaagaatacaaaaaaccgggaatttgcggtagtaacctactcttttctggggttgtttctgtgcctgatgggctattttgtgtattttgagcaggtggagagcgaacagtttatcaataatccgtacaacaaacggcaggagctctttacgcgcagcgtcgtgcgcggcagtatctattccgccgacggagtcacactggcggagacggttacggatgcagagggaaatgagacgagaaagtatccggcgggcaggatctttgcgcatgttgtcggatattccacacacggtacttccggcattgaggcgatggcgaatttcaatctgctgcgctccaacattctgtatatggagaaggcggtcagtgagatcaggggagagaaaaatccgggggacagtgtcacaacgacgttgaattatgatctgcagcttcaggcgtacgatgcactgggaagctatgacggggcggtcgttgtgatggagccggagacaggcaggatccttgccatggtgtcaaagcccgattttgatccgaacacgatcgcggatgactgggatacctttgtgtcggacgacagtgacagctcggttcttctaaaccgtgccacccaggggctgtatccgccgggatcgacgtttaagatctttaccacgctcgagtacattcatgagaatgcggactatgcggactatcattttgactgtagcggcgagtataccgtgggcacaaagaccatccactgccataacaataagcggcacggatcggaggatttaaagacctccttcgcaaattcgtgtaattcctcctatgcgtccttaggactcacactggatctggaacagtttgatgatctctgtgaccagatgctgtttaataccgcgcttccgacggatttcgagtcgtcgaagagcagctttgtgctggagccgggagacagcgattcagcggtgatggagacgtccatcggacagggtaagacgcttgtgacaccgtttcacatggcgttaatcgcttctgcgatcgccaacgacggtgtgctgatgaagccgtatgtgattgaccgcatcacggatgcggagggcgaggttgtggagcagtatgagcctgcggagtacaaaacactgctctcggagagcgatgcgtccgttttgcaggaatatatgcgctatgttgtggaggaaggaacagcgaccaagttaaagagcgacagctatgaggcagccggaaagacgggttcggcggagttctcatccagctcggacgccacacattcctggtttgtgggatatgcgcataacggggaggaaccggacatcgcggtggcggtgatcgtggagaattccggcgtgggaagcgagtatgcggtcccgattgcaaaacagatctttgatgcgtattatacatgggagaactaagcgcatacgaggttgcgtgaagtctgaaaaagtattatactggatataattatgaaaagaccacatcgggaggtattgcaatgatagaggcaacaagctgtggcggtgtggtaatattccgtggtaagatattgcttttatacaagaattataagaacaagtatgaaggctgggttctgcccaaggggacggtggaagccggggaggagtatccggatacggcaacgcgtgaggtgttggaggagaccggggtgaaggcggcaattatcaaatatgtcggcaagagccagtattcctttacggtaccggaggacacggtggagaaggacgtccactggtatcttatgatggcagacagttattacagcaagccgcagcgggaagaatattttgttgattccggatattataagtatcacgaagcgtatcatctcttgaagtttccgaacgaaaaacagattctggagaaagcttacaatgaatatctggagcttaagaagagtaatttgtggggaaatcacaaatacttttagagcagtgtgatatggagagcatgcatgacatggtatgacgagttatatgtaggggaaagtattgtacataagacaaagcgcgtgaagtggaaaatcaaccacaatgcgggacagatcggcatttatgtgatcgcgcctgcgtcgaatgacaaaaatcttctggatattatcccggctgccgaacttttgcagaaagggtatccgaagaaagaccttaagattgccggacttgccgggagttatgatgaggcgctggaagtggcggtgtcgattgtggatgaagtataccggaacacaggagcgttttttgtgcgcagttatctggatgagcaccggagcggcagggagggataatggcagttctattgctgatattaaaaataattggaatcatcctgctgatcctgcttggactgatcctgctcattttggcagtggtgctttttgttccggtgcggtatcaggtgagcggcagcatcggggagaagacgaccgtccggattgcggtgtcatggcttttgcatgcggtaagctggagggcagcgtacgaagaggaagggttttcttcacagctgcggatctttgggatcacccggaaaggaaaaaagccggacgatggagaacccggggaggatgaccgggaggacggtgcagaagaacccgaagagcgcagtgcggcagatgcccccctggcagacagtgagcagaaaacagaaggcatcttggcagacggggagcagggagaggcggaacggttcgacgagaggcaggcgaagaaagtctgcgccggggcgaaggagccggatcctgcggagcataaggaactggaacaagcgaatccggctgtgcgcagaaagcagcgcggcgggctgtttcggcggatatgggagcgtatccgtgcattctttgcaggacttgtcagaaaactgcggcagtttcgtgccggcataaaagaggctcttaagaaaataaaagatgtccgtacgtttttgacggacgagcggcacagagaggcgctgccgctcatttttacagagttaaaatacctgctgacccattttaaattccggaggatccggacggatctgacattttccatgggggatccggcgctgaccgggcaggtgctcggaggcttatgtatgcttccgtttctgtatcggtatcaggtgcaggtatatccggactttgaagcggagaatacctatgtaacaggcacatttgatataaaagggcgtgcaagaggactgcatatcgcagtatcggcagtccggctgcttggcaaaaaggagttccgcatctggctgaaatggctgatgcacagataaaggataagaaaggggtaacattatggcagataacagttttcacacaacagtagaatccctgtttaagggaatggacagttttattacgacgaagacggtggtgggcgatgcgattcatatcggggataccatcattcttccgctcgtggatgtatcatttggagttgccgcaggagcattttcacaggataagaagaacaacggagcaggcggtatgggcggcaagattatgccgagcgctgtgctggtgatccagaacggtaccacgaagctcgtgaacatcaagaaccaggacggcgtcacaaagattctggatatggtgccggattttgtgaacaaatttacctccaggaatcaggtcgcagccgatacagcgtccgctgcagacgaggatgagacgaaggcgagagaagcggctggcaaagagatggaggacatcttaaaggattccgtgaacaaagaagaaaactaaaaaacagtagagaaacttccggcagatgcatatgatgaagagacagattgtttgggggatcttatgaagcggatgatgggatttgcactgttttgcttttccatggggatgctggtgatgctcgtgctccacagccgtttctttgggttccttcttctggtattatgcatgatcgccggttactatctgttctgctgtgatgactgagagcacacggcagaggagagggaagacggaaaaaatatttatgcaaactttatattcgttggagaaaaatgtgagcatttcttccaactgaatgtttgcatcaaattccgtgtctcttccacgtttggacactcacggagtgtgtccgacaagccgcagacaatgagcggactttctggtgtccctaatggcacctcttcatagacaatataaaaccgcgcgaaccgaaactcgccggcatctgctattgaaaatagggcagatgccgactcaaacatcggcttcgcgcggttatgttttattcgacaacagatggcatttatgccatctgttgtctggtgccgcaagggacacacacaaaagtcctaaaattgtctgctggcttgcggacacagtccgtggagtgctccaaacttggaaagacacggatcatcgaagatgcaaacattcggttggttagaaattccacattttttgaaccgaatttccatctccatttccacatgaaatctccaagtgtgtttcatataatattacttatcactccaaagagatccatgcttattgcggcaattacttagttggaacggcttatgcgagcaattcctttacgcatgcagcaatggcgtcgtccttgcagtttgcatagaaatattcggcaaaatgttcgccgctcaatgcaccgacgacgagatcacggtcaagctcttttaagatggagacgagatcgcggtgtgtgacttttttcacctcatcgaggattttcttgttgcgctgctccggcacgacacgctccttcggataaccgccaccgcccggtgcacagaataatttctcgaagatgtatgtgaggtttagctcgccgccccagccgaagttctctgcgaacgggagagcaatacagttgccgtcattgacctgtgagaagagataagcatccagaggagactctacatgtccgcagagtacctgcgggaaggaattgcaggcaagcatagcaccctcgccggtaccgcatcctgtgatgacgaaatcggctgcaccggaattcaataatacagcggcaagaataccgttctggacataggtgagcggatgctcatcctcggcagagtacataccgtaattgaatacggtgtgacccgtcggctctacaacggactttaatgtgttgcagatcatttcattcttggctgcctggctgttttcgttgattaaagcgattttcataatggtttagacctccgttttataacaaatctgtcatggctacgtcgtccatgtcgtcaaaatcctgattctcaccgaccatgccccagataaaggtgtaagcctgggtgccgcatccggagtggatcgaccagctcggggagatgactgcctgctcgttgcgcattacaatgtggcgtgtctctgtcggctcacccatgtagtgcatgacaagggcatcttctggcatatcgaaatacagatagacctccatgcgtctgtcgtgtgtatggcaaggcattgtgttccatacgcttcccggctcaagttttgtcatgcccatttccagctggcagctctctacctgaccaggaaggatatatttgcagatcgttctgtggtttgctgtctccagggaaccgagttctactttgttgcagtccttgacgatgacaacaccatcttccggtgtgccttccggcttgatgagaacggttggacatgtgcggtgtgcaggagcactgtttaaatagaattttgccggtgcagcggcgtcatcgcttgcaaaagtaatgtcgcgggagcccatgccgatatacatgccttccttgtgtgcaacgtggtaagcctttccatcgatggtgatggtgcctgcgccgccgatattgatgacgccaagctcacggcgctcacagaaatactgtgcgcggagttcgtcgccggcggtcagctttaaggtctcttttaccggaacggcagaaccggtaatgatacggtcgatatggctgtataccagtttgatgacatccggcaaaaacaggtcgtcaatcagaaattcctctcttaaacgttcggtggtgtagtgtttgacatctcttggagatgcagctgttctaagttccatgataaaatatcctttctatgtattgttgcatgaaatgcccggaaaaccgggcatttcaatgggaaaccaattagcaggtctttaagtcaaatccgaagtagttgacggcattgttgtagcagattcccttcacgatctcctcaagtgtctcgtagtctgccgggaactcgccgttctctacccagttgccgatcagattgcagagaattctgcggaagtaatcgtgacgggtataggataagaagcttctggagtctgtcagcattcccacgaatccggaaaggtttccaaggttggcgagagagatcatctgatcctgcatgcctgtcttgtgatcgttgaaccaccatgcggaaccctgctgaatctttgcaactgcggtggaatcctggaagcagccgaggatcgtgccgatggcctggttgtcgttcgggttcaagctgtagatgatcgttttcggaagttcgtcactctgatttaaggcatttaagaaatctgccatctcagaagaaggagcgtagttgttgatacagtcatatccagtatccggtccgagcttgttgaacatcggtgtgttgttgtcgcgcttgcagccgtagtgcagctgcattacccagttgcgctttgcatactctttgccgacattgaccatgaatgccgtcttgaactttaattcttcttccttggtgacatcatttcctgcaagacgttttgcgaagatgctctcgatctcttctgcggaagcaggagcgtacattacatactctaacgcgtggtcggagacacagcatcccatggaagcgaagaaatccatgcggttggaaagtgccttgcacagatccgcgaaggtggcaaccttgatgccggatacagcggataactgatccaggtactccggataggtcggtttttcaatgttcattgccttgtccgggcgccatgcaggaagaacctttacgtcgaaagaagcatcctcggcgatcttcttgtgccactccagagaatcgatcggatcatcggtggtgcagatcagtgtgacgttggactgcttgatgatgttgcggacagtcatatccggctcagcgagacgcttgttgcagagctcccatacttcctcagcggtgtttttgttgagcacgccgtgatagccgaaatatttctgcagctccaaatggctccagtggaagagtggattgccgatagctttgccgagtacctcagcccactttaagaatttctccttgtcggaagcgtcgcctgtaatgaagcgctcgtccacgccgcaggaacgcatgaagcgccatttataatggtcgccgccgagccatacctgtgtgatattttcgaactgacggtcctcataaatctcctgcgggttgatgtggcagtggtaatccagaatcggtgtggctgccgcataatcgttgtacagcttttgggctgtctctgtctgcagtaaaaagtctttgtccataaatgttttcatctttttttcctccataagttgttcttggtatatttgaaaaccttaaaataatgtagtgcctcgtttgataagtttgccggaaaaaatggatttcttcggcatttcctcaccctggagaactccgagcagagtctgcaccagctgatgcgtctgtgtctcaagacggttgtcaacggaggtaagctccggtgtacagcaggtggtgagcatggaattattatatccaattaccgacaaatcttccggtacgcaaagtccctgacgtctggcgtatttcatggcgcctatggcaagcggatcctccgatgcgatcacgccgtgaaaactcagcttctttttggaaagacgttccagataattggcgacgtcgtccatctgctgcgggtctccctcgtagaagagaatccgtttctcgtaatccgggacagagtgtgcctccatggcggcgcgaaaaccgcccagctttttgacgccgctgtaggaattggaattgtacagatagagaatgtcctcaatccccgcgtcaagcatggaaacggttgcctcgaacatagatgtgtaatcgtcgcagagtgtgctgtacacattcggatagtcaaaggaagcgttgagcagcataatgggaacctgtgcggaaacgtccttgatgtactggttctcctcctcattggtaccgatgaagttggaaccaacgagaataatgccatccactttcttggaaagaatgaggtttaagtaattcttcttgatgtccagattgtaaccggtacagcataaaagggattcatagccgttggactgaagctcctgctcgagataatacactgccttggcgagaaaaagatccgaggaatcggcacagagaataccgatcgtctgtacggaatgaagtcccatgccgcgcgcaaatgcattcggagtatagtcgtatttttctataatatccattaccttttttcgggtagctggccggactttatcgcttccgtttagaacacgggagacggtggcaatggaaacaccggctttcttcgaaatgtcgtaaattgtcatggtgtgattccttttgaaactccttaatatggaagaaatgagatgcttcccagggcgttacatgtaaagttacataatgtaaggtacaaaacaagtatagctgtgaaagcagtttcattgcaaccacatttattatacaatattgaaattgagaaagcaacaacagaaacaggaaaaaataacaaaaatgccaaaagaatgaaaaaaaagtaatggaatatagataacatcactaaattgtgcaaaattacatattgactaatcctataaaaggtgtaagaatacatggtgtaaacgcttacaaagtaacaaaatgcagtatatatcagaataccaggaggatatcatggacttattaagcagagaaaaaacaggaaaggttgaaagacctgtcagagtattacagtttggagagggaaatttccttcgtgcttttgtggattatatgattgatatagcgaacgagcagggcagattcaatggcgatatcgtgttggtaaagccgatcgagttcggaagcctggatcgtttccacgagcaggaatgtcagtataccgtacagctgcgcggaattgtagatggagaaccgaagcgcattaaccgtattgtgaccagtgtggcagatgcggtagatgcatatggcgaatatgaaaagtatgcggcatttgcaaaactggatacactccgttatatcgtatctaatacaacagaggcaggaatcgtgtatgacgataccgaccgcctggagatgaacccgccgaagagttatccgggaaaattaaccaagttcttatatgagagatacaagcactttgacggtgcggctgacaagggtcttgtgatgctgccggtagagctcatcgatgacaatggtattcatttaaaagagtgcgtattaaagcttgcaaaactctggaacctggaggaagaatttactgcatggctgaatgatgcatgtgtatttacctccacactggttgaccgtatcgttaccggatatccgagagacgaggcggaggagctgtgcaaagagttcggctaccaggacaacttaatcgtaacgggcgagccgtttgcactctgggtaatcgagagtgcaaaggacatcagcaaagagttcccgcttccggatgcaggacttccagtgatctttacagacaaccagaagccgtataaacagagaaaggtcagaattttaaacggagcgcacacatcctttgtacttgcgtcctatctgtgcggcaacgacatcgtattagagtccatgcaggatgaactgatttttaacttcatgaaagcaaccattttcgatgaagtaattccgacgctgacacttccgaagcaggatctgatcgatttcgcagaggcggtaatcacaagattcaacaatccgtatgtaaagcacgcactgttatccatctccctgaactctgtatccaagtggagagcaagatgtatgccgagcttcttggggtacatcgagaaggaaggaaagcttccggtacacctgacattctcgctggcagccctgatggcattctatacaggaacagagatccgcgacaaggcgctgatcggacaccgcgacggacaggagtacaatattttagacgacgctgcggtattggagttcttcgcagccaacagttctaagggcgcgagagagtatgcacatgcagttctctccaacgaggcattctggggacaggatctgagcgctcttgcaggagtggaggatgcagttgcttcctatatagaagagatccgcgcacttggaatgcgtaaggcaatggagaagatttttgcataatacactgtgaaaaacaggcaggagacgattcatgaaggattttatcaagatcaatgaaaatgataatgttatcgtggcattgaaggaactgacagccggggagaccattctggcgggaacacaggaggttacagcaagggaaacgatcccggcgggacacaagatggcaatccgcgatattgcggccggagccgaggtgatcaaatacggttttaggatcggcaatgcgaaggagaacattgcagcgggacagtgggtgcatgtacataatttaaagacggcactcggcgatctgctggaatacacttatcagccggtggagacgaatgtgaaaaagacagaggatgtcaaattcatgggcttcgcccgcgccaatggaaaagttggcgtccgcaacgaagtctggatcatcccgaccgtcggctgtgtcaacaatattgcaaccgcaatggcgaaggcagccaacgcaagagtgaagggaagcgttgaggaagtcatcgcattcccgcatccgtatggatgttcccagatgggagacgaccaggagcacaccagaacgattctggcggatctggtaaatcatccgaatgcgggcggcgttctcgtgctcggactgggatgtgagaacagcaatataggcgaattgaaaaaatacatcggcgattacgatgagaattgcgtaaaattcctggtttgtcaggaatgtgaggacgagatggaggagggagcaaaactcctgaatgaactcatcgattatgcgtccgcgtttgagcgcgagccgatcagtgcctcaaagctgattgtcggaatgaagtgcggcggcagcgatggattctccggaattacggccaatccgctggtgggcagattctcagatcttctgatcggaaagggcggcaccacgatccttaccgaagtgccggaaatgtttggcgcggagacgcttctgatgaaccgctgcgccaacagggaactgttcgatgagacagtctcactgatcaacgacttcaagcagtatttcaaggacaatcatcagacgatttatgagaatccgtctcctggaaataagaagggtggtatctcgacactggaagataaatcactgggctgtacacagaagtccggaagcgcaccggtgtgcggcgtgctttcctatggagagtgtgtaaaaacctcaggattaaacctcctgtctgcaccgggcaatgatctggtggcggcgacggcacttgcggcgagcggcgcacatatcgtactgtttacgacagggcgcggaacaccgtttgcgtccccggttccgaccgtgaagatttccagcaacagtacgctggccggaaagaagaaaaactggatcgacttcaatgcgggcgtgctggtggaagacgcggagttagacacagtgggacagcagctgttcgactatgtgatcgacgtggcgtccggcagaaaagtctgcagcgaggaagcgggcttccacgatatggcaatcttcaaacagggcgtgacactgtagctgaaaagcagtagttaagcaatcgatgcggctttcggccactgcggctgatgccacatgaataatagaaaaggagaacataaaaatgggaattttagacaatttttcacttgagggtaaagtagcacttgtaacaggtgcatcttacggaatcggttttgcaatcgcaactgcattcgcagaggcaggcgcaacaatcgtattcaacgacatcaggcaggaacttgtggacaagggacttgcttcctatgaagagaagggcatcaaggcacacggttatgtctgcgacgtgacaaacgaggagcaggtggaagccatggtggcacagatcgagaaggaagtcggaacgatcgacattcttgtcaacaatgcaggaattatcaagcgcatcccgatgcttgagatgaaggcttctgagttcagacaggtcatcgatgttgacctgaacgcgccgtttattgtatccaaggcagtcattccaggaatgattaagaagggtcatggaaagatcatcaacatctgctctatgatgagtgagctcggccgtgagaccgtatctgcatacgcagctgcaaagggcggattgaaaatgcttacaagaaatatcgcgtctgagtacggcgagcacaacattcagtgcaatggtatcggaccgggttatattgcaacaccgcagaccgctccgctccgtgagatccagccggacggctccagacatccgtttgaccagttcatcattgcaaagactcctgcagcaagatggggcacagctgaggatctgcagggaaccgctgttttcctggcttccgatgcatccaactttgtcaacggacacgttgtatatgtagacggcggtattctggcatacattggaaaacagccacaatagactacattccgcacatatttgcccatgaaaacatttctaacaaaaaaaagctaaaatatgaaaaaaagtagtgcatttttatgaggactgtgctataatacaacatgtaagcacttacattattgcaatgtgactaaaacctttcagagtgcaaaacgatgaaagggcacattgccaagtaataaagaaaaaggagaagaaaactatgaaaaaggatttcctgaaacgcacaatggctaccggtttagtagcagccatggcactttctaccgcagcctgtggaagttccacatctgaggagacaaacacagacgcagcagccacaacaccggagactccggcaacagaagcagcggcagctacagaggcagcagctaccgatgatggttcttatgagaattgtacattaacaatgtcatggtggggtggtgacaccagacacgaggcaacattaaaggcaatcgaggcatttgaggcagcttacccgggaattaccgtagaacctacatacgctgcatgggatggatgggaagctaagatggctaccgcattcgcagcaggaaccgcacaggatgtaaaccagatcaactggaactggattacacagtatgacaacgatggaaccgctttccttaacctgaatgattactctaacgtaattgatttcagccagatcgattccacatatcttgatatgtgtacagcatctgacggatcccaggcaggtatcccgatttccatgacaggtagaattttctactgggacaagacaacatttgatgagatcggatgcgagatcccgaccacattagaggagttaaaggcttgcggtgagaagttcgcagcatacggagatgattactatccgttagctttaggtgagtacgacagaatgatcctcatggtatactaccttgagtctgtatacggaaccgactgggtaacagacggacagatcaactacacaacagaccagatcgcagagggacttcagttcatccaggatcttgaggatgctcatgtgattccttctgtagcaacaatcgctggtgacggtgctgcatctctggatcagaaccagaactggatcgacggacactatgcaggtatcttcgagtgggattcttctgcaagcaaattcgcaagcgcagctgagggacgtgagatcgttgttggtgactacttaacagatcttggcgagtatcagggcggatacgcaaaggtttccatgtgctgggcaatcagcgcaacatgcgagcatccgaaggaggctgcattacttgttaacttcttaatgaacaacgaagaagcagcacagatccttggctctgagagaggtgttccggtatctcagatcgcattaaagacagctaacgatgcaggcttattaaatggccaggtagtagaggctaacggtaaggttcttgcatgggtatccaacagccttgatccgaagttcgaggattctcagttaaagagcagcgatggtgtatactatgatgtaatggcaggtttaagctatggcgattacacagtagaggaagcagcacagacattatatgatggtgtaacagctgttatttcccagtaatctgactgcatgaattcggagctgctgttcttacgacagcagctccatttttaaaaaaggtgtatgatggattttgatcagtttgtatcagaatatatagcagaggatcatgattttgagcagctttcggtcatggttttggagggatgcagagcatggtatcccctggccgcggaagcggaaaagcaaaagctgcaagaggtgatggagaaagctgcccgtgcggcggtaggtgcccaccggtttggcaggtacgtattttttctgtatgatcagacgggagaagaacagtatcgcacctggatagaaagaaatgcagagtggcttaagaacagcccgcagtccgaaaacggcgtattcggatgcgtggaggattcttcccggaacatatccggcagtgtgatgtttgcggtgtatccattctatatggagtatgagaccagatatcacaacaaggcggagtacgcacagatcgtcagacagcttctgacactggcaccgtcggaacagacggatatggagcagacggggtggtatcttatgacggtgatcgacgtgatagatagcatgagtcgtgagattttcgaacattacaaatctctcgaagagatttttaagaagaccatcagaaatattcttgccgccggctggaataatgatttcagtaaaaaagaaagtgcaatgatgggatattctattataaaggcttgcaatctgggcgttttaaatagtgaaaaatatgcagaaattggactttccatgatcgatggtctgataaaagaaccgtttgattcaaaagattccgaacggatgggcatagccatgatggcttatgcgcagagactgattttaagtcgtgagtgaatgaaattttaagataagtaggaggtacaaaaggttggctaagaaaagtaataccgcaaatgttgcagtgccaaagaagaaaaaaacgtttgttgacatttgcaaagaaaatatcggcttcttctttattttgccatggttgtttggtttccttgtattcaaactgtggccgatgggttcctcattattctacagctttacagactacaatctgtttaagggcatgaatgtgatcggaacacttcagaactatgtgaatgtcttcacaaccaagaagattacgacagcgttgacggttacattcaagtatgcatttatcacagttccgttaaaactgatatttgcattgtttatcgcttacatactgaacttcaagatcaagggcgtgaatttcttccgtaccgcttactatgtaccttctatcttagggggatcggttgccattgcggtactctggaaagcagtattccgcgatgacggacttttaaacggattcctcggtcttttgggtattacaggcccgagctggctgtccgatacaaagtattccctgttcgtaatctgtctgcttcgtgtatggcagttcggttctgcaatgattattttccttgcagcgttaaagggtgttccacaggatctctacgaggcggcttcgatcgacggagcaggcaagtggcgtcagttcttctctgtgacagtgccgatcattacaccggttattttctacaacctggtaacacagctctgtcaggcattccaggagttcaacggaccgtacatcatcacacagggcggaccgagaaactctacaacactgatttcacttttgatttacaacagtgcgttcaaacagtatgacatgggtatggcaagtgcgatggcatgggtaatgttcgtcatcctgatgatctttaccacgattgcattcctgagccagaaatactgggtattctattctgatgaggagggctaagaagaatggcagcagaaagtaaaacaaaacattatgtcaatgtattcttaagatattttgtcctgatccttgtcggactgattatgatctatccgctggtctggatggttggtgcaacttttaaatccaatgcggagattttctccagcatcggtttcatcccgaagaacccgacacttgagggttacaaaaaggcaatggagagctacggcggagcaatcaacgtatggaaggctatgttaaacaccttttcctacgtaattccgaaggtagtatttacgatgatctctgcgacggttaccgcttatggattcggccgttttgagttcaagggcagaggaattctcttctccgtattgatggcgacattattcctgccgcaggtagtattgaacgtaccgcagttcatcatgttttccaagatgggctgggtagattccaagttatatctcccgatcattgtgccgaccctgttcgcgacggatacgctgttcgtattccagctgattcagttcctgcgcaacgtgccgaaggaattggatgaggcggctaagattgacggatgtaacgcagtacagactctggtgaaggttatcgttccgatgctttccccggcgatcacatccatcgcactgttccagttcatgtggtcatccaatgacttcatgggaccgttgctttacgtgaatactccggcaaaatatccgctggctattttcgtaaaaatgtccatggatgcagattccggattccagtggaacagaattctggcactgtccctgatctccatcattccttctcttgtggtattctttatggcacaggataagttcgtagatggtatttcagccggtggtgtaaaaggctaaaatcaaaaacaaagcttagaaaaagggtggcaggcttgtcacccttttgttgcactgtaagaagtaacgaatgaccgtaaggtataaatggaggatgagacaatggaaattcgtcttgtgatgaaaacggcgagaagcgtctcgctggaactggatgacggcggcatctataagacaaaagaagtgtaccggattcttgtaaacggagatgaggtaaagacaaccgataccgtcatcacgtcgctgtatggcttgaagccggataccgactatgagattggcgtggaggatgcccatggaaccagacagggagagattgcattccgcacggattacgagttcgtcacactcaatgtgcgcaagttcggtgcaaagggagacggtgtgtcggatgacaccacgtttatccaggcagcgatcatggcatgcccgcctgagagccgtgtgctgatcccggcaggaacctataagattaccagtctgttcttaaagagtgggatcagcgttgaactggcgaaaggcgcggaacttttggcggacaccgaccggtcgcactatgcaattctgccgggactcatcgagagctatgatgagacgggagactataatctcggaacctgggagggaaatccgctgccgatgtttgcgggaattatctccggaattgacgtttcggacgtgaatctctacggggagggcagcatcaacggagctgccagccacgaaaactggtggaaaaatgagaaggtgatggtgggggcgttccgcccgagaatgctttccttaaaccgctgcagaaacatccgcgtgcagggactttatttccatgacagtccggcatgggtgattcatccgtacttcagcgacgagctgctgttctgcaacctgatcgtggagaatccggcaaagtcaccgaatacggacggtcttgatccggaatcctgccgcgatgtgacgatctgcggtgtgcgcttctccctcggggatgactgtatcgcagtgaaatccggaaagatctacatgggaagaagatacaagacgccatcctccaatattcacgtctatcagtgcctgatggagcatggacacggcgcggtcaccgtcggcagtgagatggcgggaggcgtcaataacctgatcgtggagaaatgccggttttaccataccgaccgtggtctgcgtatcaagacgcgcaggggacgcggcaaggatgcgattctggacaatattatcttccgggatcttatgatggagcaggtcatgacgccgtttactgcgaatgccttctatttctgcgacccggacggaagaaccgagtttgtgcagtcgagagaaccgtatccggtggatgacggtacaccgtccatgaagcgcttctgctttgaaaatatcacggcgaaagactgccatgtggcagcatcctactttgacggtctgccggagcagaagatcgaacagattaccatgcgcaacgtatccgtttctttcgccgggcaggcaaaatgcgacgtgccgatcatgtcaaacggcgtggaagcatgctgcaaaaagggattgtatgcgcggaacgtgaagaagcttgtgctggacaacgtctccattgagggatgcgagggagaggagatcgaacttcacgacgtggatgaggttgagcgatagaaggcggccggaacattggcggggcaggagaaagaaagcccggaaaggatggaaaaaatgcagcttggaatacgtttacatgatatcaaaaaggcaccgcttgaggagcggcttgccattgcacatgagcagggatttgcctgcggacatctggcgctggcaaaggtgatttcagagtatccggtggatgacggtgccctgacgccgggatacgccatgtatttaaagaagatctttgcggcaaatcagctggatgtggcagtgcttggatgctacttgaatctcgccaatccgaatccggcaagccttgcaaagaatacgcaccgctatctggcacatatccggttcgcatcgctgctcggcgcgggtgtggtcggcacggaaaccggagcggtgaatgaggaataccgttttgaggagcgcaatcattccgaggaagcgctaaaaatctttatcaacaacctgcgcccggtggtttcctatgcggaaaaaatgggcgtgatcgttgcgatcgagccggtgtacaagcatattgtctgcaatccgaagcgggcgagaaaggtgcttgacgcgatcggttcaccgaaccttcagatcattttcgatccggtcaatctgcttgatgtttgcaattacaaggacagggatgctataatagcagaagcgatcgatgtgcttggcgaggatattgcgatggtacatatcaaggattttaaggtggagaataacagcctggtatcggtggcagccggaaccggcgagatgaactatgacaggatcatccgctttatgaaagagcgcaagccgtatatccatgcaaccttagagaacactgtgccggaaaatgccgtggcatcgcgcgaatacattcagagattgtgggaggagtgccatgtgggatagattttttgatctcgacaacgtggtttggcgtaccattgataaaatcggaaagatatttttattgaatctgctctggctgatctgttccctgccggtgtttacgatcggggcatcgacgaccgccctgatttacaccagcatgaagctttcggacaatgaagggtactggcatcagaattttttctcgtcgtttaaggagaactttaaacaggcgacggcgctgttttttatttatctggcagcgggtgcattcctggcgggcgacttccttttgggcggccgtgccggcaattccttcgggcagctgatgcagggagtggcggcaattctgtttgtaccgtattttctttcgctcctctatgtgttcggcgtgcaggcaaagtttgtgaatccggtcaaggcgacgatccggtattccttttttgtcgcaatgcgcaacatgaagacgacgatccagcttgcaatcttgatgattctgtttgtctgggtgaacacaaccacgctgcttgccaatttcctgacgctgatctatggaatcggtctgatggggtatttctttggaatgtactataagcatacgttcgccaaatatatcgaggcggcggaagaagactccgcagacgaagagcaggagcgttagcggacggacacgaagctgttccgacgaaaacaagcataatgaaaaggaattgtcgcaataagcatattgtgctttgttttgataagtaatattacaggaaatagatacttaaaagttccagataaacatgcggcgacaaattctgaccgcaaaatccggtatttctaaccatgccgcagctgacatccgtgatgatccgtgtctttccaagtttggagcactccacggactgtgtccgcaaaccggcagacaattttaggacttttgtgtgtgtcccttatggacacctctgagcaaaacataaccgcgcgaagccgatgtctgagtcggcatctgccttattttcaatagcagatgccggcgagtttcggttcgcgcggttttatattgtctgtgaagaggtgccattagggacaccagaaagtccgcccattgtctgcggcttgtcggacacactccgtgagtgtccaaacgtggccaagacacagaatgggatgccagccacggcatggaagaaatacgtgaattttgcttcaaagaatttgccgccgtctgtttattctggaacttttttgttctctggtattcctgtaatattacttatcgctcgaaagaggtctatgcttattgcggcaattctatgctgcatcagtcttcgacgacgcccggctcaaaggcgaccggggcggcggaggagccgagcggaacgcagtagctctgatctgtggaaaaatcacggaagtatacatattcggaagtgattgtaatgtccttgaaatttccctcgaacagtgtggtgtaaccgctgccgtccgtgcacatgaatccgagacacggatgttcggaatcgtttttctggaagtagatataatccccgtagaggttgtaccagtccacgcggtcctcggacagaagtgtcttctcaccggtggcaagatccgtgcgggcgatcgcgtagttgctgtcgcagtccatgaaataggcggtggtatcgtctatgacagtcggcatataacagttcccgccgtagagcatgccctttgagtcgtccgtggtattgagccgccagatatagtgatcgctgtcggttccgttgtaatacatatattcgccgtttgccgagcaggtaaagtcgggagcggtgtcgacctgcttgcagccggaaccgtcgatttttaccttataaagtgtggaaccctcggattcatcatagcggatatagtaaatataattcccgtagagggaagcgtagaggcacggcgccgaatccagaatcagaacggagtcatcgccgccttccctgtcaatgcggcagagactgtcggtgttgacagagagaaaggagagagcggcgcccgttgctcccggattgttgcgcacatagtagagataatgttcgtccgcgttgatgtaggataccgtgtcatcacagagcttggccagattgcttccgtccggagacatcgaatacagcttcccgccgtcggacgggttggaaaaatataccgtgccgtcgtactcgcagaagagaccgccgttgtagaggttgccagcggtgttgccgttcacgtaaccctcattaaaatgagtccggttggagagatagtggaaaatggcagccgctgcgataagcgcgataatgacgatgacagcaatgataatggaaatcttttttttcatggaatgattccttctttcgtctgaaatgccgataaaatataatcatggaaattataacattttcgtctaataacttgcaagggttctcttgtcatcagcacgttaatgtactatattataaactaaggcggagtcggcacaaaagagcacccggcggatgccctgatacgaaaaggaagtcagacggtaaggagcactatgaagaatctattagagttgagagatgagattgatgtcattgacaagcagatcgttgcgctgtatcagcagcggatgcagatcgcggctgaggtggcggaatataagatagagacgggcaaaaaagtttttgacaaagaccgtgaaatggaaaagcttgcgacgctttcggcgctcggcgacagcgcgttcaaccggcacggaatccgggagctgttcgagcagatcatgtcgatcagtagaaagcgccagtatcagctgatgacggagcacggcatatacgaaaagccggattttgaagagctggacacgttggattataaaaatgcgcgcattgtctttcaggggacggagggcgcctacacgcagctcgcgttaaaacagtatttcggtgaggatgcggggaacagctatcatgtggagacctggagggacgccatggaggcgatcgcccgcggggacgcggactatgcggtgctgccgattgagaattcttctgccgggattgtctccgagaattatgatctcatggtggagtacggtcactgcatcgtgggcgagcagattatcaagattgaacatgcactgctcggcgtgccgggagcgaagctttccgatatcacggatgtatactcgcatccgcaggcactgatgcagtgtgctagatacttagaaggacaccgggagtgggagaagcacagcttaaaaaacaccgcgatggcggcacagaaagtcagggaggacggcatgcggcacaaagctgccattgcaagccgtattacggcggagatctacggtcttgatgttctggaggaaggcattcaggacaacaagcagaatgcaaccagattcatcatcgtgacgggaaaacatgtgtttaccagaaaggcgaataagatcagtatctgctttgagggagcgcatgagaccggttctctctaccacatgctgtcccatctgatctataacgggatcaacatggatcacatcgagtccagaccgctgccggagcgcaactgggaataccggttctttgtagactttgaggggaatctgaacgatccggcggtgcagaatgcactgcggggattgtcggaagagacgaccagactgcagattctggggaattacgaagcgtaaagtgaggaatgtgggaagatgaagacaacgaagaatctgatcctctacagggattttgaaaacgagcagttattctatgactttacctgggtcatggagaactatcagaatgaatactataataaagaagatgttgagggattattctatgaatgcctcaaaaaactgatggagcttgcggtcagccacggattttccggcaatctctggcacaatttcctggcttttttgcttgtgaataacgagaatgcatacagcagggcgtgcgagatccgcggggagataaaaggctccatcaacgaggtggcgcggcacgattttgccatcatgaaagagttgtttgactttgacctttcggtgctcggcaactatttttccgtggactgcatggacgcattgctgcactatgaggagaccgcggacgcgggaaaattgttcaacaagcggatcagagaccggatcgcagagctctgccgtcatctggaggcagcggcggatgcagaagaatttaaacaggcggtcacggcattttacggggaattcggagtcggaaaactgggtctgcacaaggcattccgcgtcagacacacagatgacggggctcagattattccgatcaccaatatcgcgcatgtaaagctggatgatctggtcggctacgagcttgcaaagcagaagctggtcgacaatacggaggcgtttgtgagcgggaaggaagccaacaactgtctgctgtacggtgatgcgggaaccggaaagtccacaagcatcaaggcgattgccaaccagtattacgacagaggcctccgtctgattgagatttacaagcatcaattctgcgatctgaatgatgtgattgagcagatcaagaaccgcaactacaagtttattatctatatggacgatctttcgttcgaggaatttgagattgaatataagtatctgaaggcagtcattgagggcggtctggagaaaaagccggataatgtgttaatttatgcgacctctaaccgcagacatctgatccgtgagaagttctcggacaaggaagaggtgcgggaggatatgcacacttccgacacggtgcaggaaaagctttcactttatgcgcggttcggcgtgacgatctattacggcgcgccggataagaaggagttccagaagattgtcacgacgctcgcggagaaatatggcgtgcggctggagcaggaggagctgcttcttgaggcaaacaagtgggagcttgcccacggaggactttcgggaagaacggcacagcagtttatcaattatctgcttggaaaacaataaagaggagggcggatttatggcaatccatacgtttgcggcaatttatatcggttcgtatgaagtgagcctcaagatatttgaattgtctgccaagaaaaaaatacgcgatatcgactatgtgcgcagcagaatcgagctgggggcggatgcgtactccaagggcagcatcggctatgaactggtggaggcactctgcgataccctgcgggaatttgcgcagatcatgaaagagtaccgggtggatgcgtacgaggcgtatgcgtcggcggtactccgcgatgtggacaatgaactttttatcctggatcagatcaggctgcgtaccggtctgaccgtacatgtgttgagtaactcggagcaccgttttatcagctacaagtcggtggcgatgcgcgaggagtttgagcatttcatcggcagaagcgcagcggtggtggacgtcagtggatcgggacttcagattaccgtgttctcaaagggaaaggtgctgaccacccagcatctggggctcggcaccatgcgcatgcgggaacagcttgcaaaaaagagccggaacctggcgcagtatgaactgcagatcgaggagatggtggtaaaggagatggaagttttcaaggcgatgtatctggaaaaccaggagatcgaatatctgattgtgatcggcgattatattgcggaactggtctgccgccttgagaagaaccacaacaagaataccgtgtcaattgagaagttcgtccaatacatggaacagctcggcaaaaagagtctggaggagatcgcggaggaactggggctctccaacgagaacgatccgctgatcgtgccttatatcatcatctgcaagtgcatggcaagagggctgggcgcaaaggaactgtgggcgccgggcgtgattgtcagcgacggaatcgcctgcgactacgcgcagaaaaaccgtatctataagcccacacatgattttgatgaggatattatctcggccgcggaaagtctctcgagacgttacatgagctattcaccgcacattgaagcgctgacccagatggcgatgcttttgtttgacacgatgaaaaaacagcacggtctcggaaagagagagcggctgttgctgcaggtcgcggcgattttgcatgactgcggaaaatatatcagctttgccaatgccccgcagtgcgcatacgacatcatcatgtcctcggaaattatgggactgtcgcatctggagcgtgagatcgttgcggggacagtgctctacaacagctatccgcttgccgattatgaggatgtggcggaccggctcgaccagcagagcttccttacggtggcaaagttatccgccattctgcgcgtttccaatgcgatggatcgcagccacaaacagaagtttaaaaacgtaaaagcacagcttcgtgacaaagaactgatcattacgatcgagacggatgaggacattgcgctggagaaggcgctgttcgcttccaagacggcttattttgagcgcattttcagcatcaagccggtcgtgaaggaaaaacgtgtctattcgtaaggacgtggagggatgatacatggaaaaagaaaagaaaaacgaattccatttgccggaatattacgagaacagagagctaagctggctgaagtttgacgcccgcgtgctcaacgaggcaaaggataagagtattccgctgttagagcggctcaaattcgtgagcatcacgtcgtcgaacctggacgaattcttcatggtccgggtcgcgtcgttaaaggatatggtacatgcggactaccgcaagcgggatattgcgggcatgacggcatcggagcagctcgaccggatcaacacggcgaccagaaaactcgtcgagagccagtacaacacgtataaccgctccctcgttccgctgatggcagccaacggaatacacattattgaaaaatacgaggaactgacggctgagcaggcggcgtacgtggatcgctactttgaggaggacgtctatccggtattgacgccgatggcggtggacgcatcgcgcccgttcccgctgatccgcaataagacgctcaacatcgcggcgctgctttccagcaagaaggatgaaaagcataaggacgcggtggaatttgcaacggtgcaggtgcctggggtactgcctcgcctggtgccgatcccggcagatacgtcggagaatttcggggaggtggagggacgcacctttattctcctggagcagattatcgagaaaaatattgataagctgtttttaaactaccatgtgctctgcgcacatccgtaccgcgtcatgcgtaacgcggatctgccgatcgatgaggatgaggcggcagaccttttaaaagagatccagaaacagttaaaaaagagacagtggggcgaagttatccgcctggaagtggaagcttccgtggacaagaagctgctgcgctttttaaaggatgaactgaaagtggcggaggaggatatttttcagatatccggaccgattgacctgacatttctgatgaagatgtacgggctctccgggtgcgattccctgcgctacgaaccgtataagccgcagcgcgtgccggagattgaaccgggggaggatatctttgaggcaatccgggtcggcgacattctgctgcatcatccgtatgagacgtttgatcctgtggtcgattttatccggcaggcggcgtcggatccggacgttcttgccatcaagcagacgctctaccgtgtcagcggcaattcaccgattatcgcatctctcgcgcaggcggcggagaacggaaaacaggtgtcggtgctcgtggagctgaaagcacggtttgacgaggaaaataacattgtgtgggcgaagaagttagagcaggcgggctgccatgtcatctacggtctggtcggccttaagacgcacagcaagattgcgcttgtcgtgcgccgcgaggaagatggcatcaggcgctatgtgcatcttggaaccggcaattacaatgattccacggcaaagctctacacggactgcggaatctttacctgcaatgaggcgatcggggaggatgcgaccgcggtgtttaatatgctttccggatattccgaaccgctttcatggaacgaactggtgctggcgccgatctggctgcgcacccgttttatgcgtctgattgcgcgtgagacaaagcatgcgcgcgagggaaagccggcaaaaatcgttgctaaaatgaattccctgtgtgatgagggcattattgccgcactctatgaggcatcggcggcaggcgtagagatcgaactgatcgtccgtggaatctgctgcttaaaggtcggaatcccgggaatcagcgagaatatccatgtgcgttccatagtcggaaatttcctggagcacagccgtattttcttcttcttaaatgacggggaggaggaactctatatgggaagcgcggactggatgccgcgaaatctggaccgtcgtgtggaaattttgttcccggtgctggacgatacgctaaaagaaaaggtaaagcatattctggatgtggagcttgcggacaataccaaagcccatgtgctaaagccggacggagaatatgagaagatagacagaagagggaaggtgcttgtcaattcccagaagcaattctgcgaggaggcggttgcggcggtgccaaagacagatcatgtctaccgcgagcgtgtatttgtcccggcagaaccggcagagtaggaacgccgcaggacatatgatgggctaaaagcaggatgggaggaatgagtatgaatcacaagattttgtttgttgatctggatgcgacgctgctctctgacgacaaaacagtatccgaagaaaaccgggccgccatccagaaaatgcttcttgccgggcacgacattgtactctccaccgggcgcccggtggagagcggcagggcggttgcgagagaactggagctgacgcagccgggctgctatatgattgcctttaacggtgcggtactctacgactgcgctgcggaccgggtgctgttaaaacgctcgctcccgattgaggtgacgcaggaactctttgagagagccgcaaaggcgggaatttatgcgcagacctataataataccgagattattaccacaagacatacggcagagcttgagtattacaggaaaaaaacaggactttcctacaagctttcggcgaatgtgctggatctgctggaggaggagccgcagaaggttctcatgattgatttaaaaaatacggggcgtctcgcgcggttccgcgagaagaatctggaatgggaaaagggaaaatgtaccagctttttctcctgcagagagtatctggaatactgtccgcttgataccagcaagggaaccggtgtgtcctgtcttacgaagatgctgaatcttccgctagactgtacggtagcggtgggagatgaggagaatgatattgcaatgcttaatgcggcgcatatcggggtagcggtaaaaaatgccacgccggaggtgaaagccgcagcggattacgtgacggagcacgacaacaatcacaatgcgatcgccgaggtgatcgagcgatttatcctgtaaaaggagggactgctgcatcgggcgggcagctgccttgagtcgataaggaatattataagaagcacaccacgcagatttcagctggaaatgcagatggaacattcgtttgagaaaaatgtgagcatttcttcctgctggatgtttgcatcggattccgtgtctcttccacgtttggacacttccggagtgtgtccgacaagtcacagacaatgagcggacttcctggtgtccctaatgatgccgcttcgcagacaatataaaaccgcgcgaaccgaaactcgttggcatctgctattgaaaatacggcagatgccaattcaaacatcggcttcgcgcggttatgttttgttctgcggcatccataagggacacacacgaaagtcctaaaattgtctgctgacttgcggacacagtccgtagagtgttccaaacttgggaagacacggattatcgcggatgcaagcatccggcgggttagaaatgccactttttttgaacagaatttccatttgcattttcaactgaaatccccaagtgtgcctcttgtaatattccttatcgcttcaaggcaaactggctattcccgatgcgacagtcctttcttctgcctttatgcgcggaggtgttctttgatggtttcaagaacggaatagggaatgtagagatgcccgcgtccggtcccgatctggattgtgggtttgttggtgccgtggaagtcagagccgccgctgatgagaagcccgttctcttttgcaagccgcttgacgtactgttcctcgccggtggtgtaggtcgagtagatcgcctcgatgccgtcaaggtggacttcttttaactcgtcgatcagatgctgcaaggtcgtctggttcatgtggtagagcagcgggtgtgccagaacggcgatgccgcctgcggcgtggatcagttcgactgcctccatcggggagactttaaagcggccgacatagcatttgcagccgtcgccgatatatttttcaaacgcctccgagacgctcctaatctgatggctgtcgtagagaaaacgtgcgatatttgcgcgcgtgatgacactgtcgggattggcagcaaggagtgcttccgtggtaatggaaaagccttcgcgctgcagggcagccactattttttcattgcgcgcatcacggcagcggcggaactcgtttgttttctcgataaggagcgggtgctccggatcaatgtagagaccgacgatatggacttcttttccaccgccggctctggtgggcagctcatattccgtggaaagctcgatgccggggattaattcaataccacaggcggcagcggcgggagcagctttagagacacctgccgcggtgtcgtgatctgtgagcgcaaaggcggacagaccggcagcctttgcggcagatacgatctcggtgggagtaagggtgccgtccgactcggtggagtggacatgaagatctatgatgcggtgttccatggtaaaatcctctcttcagataatctaattcagactaatcatagagaaaaaaatcacatttgtcaaaaaaatatggaaaccagttgaacacgtagtaaaatagaactataatacaaaggtactaaaaaatatacacggatgtagagaatacagcacacaggaggagcgaaattgtttgaaaatgtacgaatcaaagagagactgacaaaagcatttgttatggtggcggcaatcactgccataggagcggtagtcgggctggcagcgatgcttgtgatgtcgaaccgttattccagcgcacttgtgaattacggtttttcacagggagatatcggcaaggcgatgatcacatttgccaacacgagatcagcgaccagaggaatcatcggatttgatgagcagggactgttggatgatgccatgacagaacatgacgaacagaaagcaaagttcgagaattacttcgcaaccgttggggatgtagtaacgacgagcgaggaaaaggcactctaccagcagatttcagataaactgcagcaatactgggcagcggaggaaccgatcatcgagcagggtgcaaccaccgatgctacacagtccacagcggcacagcagcagatgaaggaaagtctggatccgatctacgaagatatctatgcagatatgatagaactgatgaatacgaaagtgacggagggagaccgcttgtcctccactctgacggcagtcagcgtgattcttgcgattgtgattgtggcagtgtcagctctggcaatggttatggccaacaagcttggcaatcaggtggcaaagggaatctccggaccgcttgaggcacttggcgagcggtttaaaacgtttgcacagggagatctttctactccgttcccggaggtttccacgcaggatgaggtcgcagacatggcgcgtgaggcggcagacatggcagataagctgaatcttatcatcaatgatgcgggaagaattctcggattgatgtcacagggcaattacgcagtgcagtcggagcacaaggacggttatacgcttgattttgaaaaattgattgtggcgatgcgcgttctgcgcgatcagatgatagagacgctgacatcgatcgaagatgcggcaaaccaggtttctgccggttccggcaaccttgcagaggcatctcagagtctggcggagggcgcaacggatcaggcaggagctgtggaagaactgcaggcgaccatcacaagcattacagagaatatccagaagaccgcggagcaggcagaggaatcttaccagcaggcaaggcagtatgcaggtgaagcggatcagagcaagaatcagatgcagtccatgattgataccatgagccgcatcaacgaatcttccaacaagattggaaacattattacagatatagagaatattgcgtcacagacgaacctgctgtccttaaacgcttccattgaggcggcgcgtgccggcgaggcaggaagaggattcgctgtcgttgcagagcagatcagacaactggcagagcagagtacacagtctgcggtggacaccagagaactgattgaggcttccctcaaagaaattgaagagggcaatcaggcagtagagcgtgtgtccacgtctcttgaagaggtaattgacggaatcaagcagattgcggagacttccaagcgcttgagcgataattccaaggatcaggcagaagccatgaaacaggcggaggagggagtcaaccagatttccgaggttgtacagtccaattctgcaacggcgcaggagtcctcggcaacgagtgaggagttgtctgcgcaggcgattgcactggatgagctgattgggaagtttgtattaaaaaattaaaaattgacagattctgcggttgccgaaccgaaagaaaagggatataatagcaagaagaaaagtttcagaacaggggggaagtcacatgcagctgctgacatttacattaacgggaatggattatggaatatcacttgagaacgtggaatccattgagagtaagatgaatgtcgtggttgtaccgacttctcctgccaatatcagaggcatcatccgccttcacggagagatcctgccggtgttttcccttgcatccagatttggactggggaacattgcggtggacaaccttgtggttgtcaatgtgggcggcatgaagctggcacttgaggtggaaaaggtaaaggaaattgtggacgtggaagattccagagtgcttccgatgccgacactgatgagcggacagcagtgctgttttaatgatgtggcttcctgtcagaaggagctgattgtgatgcttgatgtcaagagtctggtatcacaggaggagcaggcggcgatccgcaagatgatcagcgacaacaccagcgacaaataataaaaaacacttgacacggatacgtgtgtgtgatagatttaaatagttgttagaaaacaaagtagagtatccactctcaccggagcacaaatacgtgactcatggttcatatttcaaagtattgcgaacatatcatgttccgggtttgaatgtttagtggatagtctgcctatccacttttttatttggaggtacgataccattagcgagttaatgattaacgaacagatcagagacaaggagattcgtctgatcggagagaacggagaacagcttggcattatgtcagcacgcgaagcaatgaagctggcggaagaggcagagcttgatctggtgaagattgctccaaccgcaaagccacctgtatgcaagattatcgactacggcaagtacagatatgaactggcacgcaaggaaaaggaagccagaaagaagcagaaagtggttgagatcaaagagattcgcttgtcgccaaatatcgattcaaacgatttgaacaccaaaatgaacgctgcgaagaagttccttagcaagggagacaaggtgaagatcacattgcgcttccgtggacgtgagatggctcatatgaatgcgagcaagcacattttggatgattttgccgcaagcctcggcgaaatagcagtagtggaaaaagcaccaaaagttgaaggtagaagcatcagcatggtgttggcagagaaaaaatcataattaaggaggaacatatcatgccaaaaatgaaaaccagcagagcagctgcaaaacgtttcaaagtaacaggaacaggaaagttaaaaagaaataaagcttacaagagacatatcttaaccaagaagacaaccaagaacaagagaaatcttcgtaagccggcaatgaccgatgcaacaaacgttaagaacatgaagaagattttaccatatttataggaataagttaaggaggaatgcaaaatggcaagagtaaaaggcggattaggcgctaagaaaaagcataatagaacattaaaattagcaaagggttacagaggcgcacgttccaagcagtatcgtgtagcaaagcagtctgtcatgagagccttaacaagttcttatgcaggcagaaaagagaagaagagacagttccgtcagttatggatcgcacgtatcaacgcagctgcaagaatgaatggtatttcttacagccagatgatgcacggattaaaggtagctggtgtggacatcaaccgcaagatgttagcagagatggctgtaaacgacgcacagggatttgcagcactggcagagctggctaagagcaaggtagcttaaggaacagcagacagaacctatctcgtatgtgggacaacccatatgagataggtttttttatgtaacaggaaagcaggattttttggtatcggtattatacagcatctgaattttgtatgttccaatttacagcaatatacggtataatattagcgatttttgaacgcaaagggaactacgaaagggaaacgggaatatttatatgaagaatatatggcgtatttttgcaaaagacattaagggactggtgaagaatccattcgcaatgattattgcgctgggactctgtgtcattccatcgctgtatgcatggtttaacatctattcaaactgggatccttatgcgaatacttccaatatcaagattgcggtcgtgtcggaggataaaggatacaccctttcggatggaacgacagagaacatgggcaatgaagttgtggaggaactgaaggagaataccaagatcggatgggtgttccttgaggattcggatgccgcacttgaaggtgtcaggaacggagattactacgcggctgtcatcatcagcgatagctttacatacagtatgtataatgtgttcaaggagaactttaagaatccgacgatcacatattatgagaatgaaaaacggaatgcggttgcaaccaagattacggataccgctgtatcgacggtaaagcagagcatcaacgagaagtttatcgaggtggttgcaagtaccatttttacacagacgaacgaactgtcctctgagatggagaatcaggatgtgttcagcgaatttgagggcaaactgaccaacctgaacaacaatctgatcggttacagtgatatgattgatgagtttatttcggcgaatgcagtgctggaggcagagatcaaaaccgcagacggagaactgccgaagctcagcagccagattcagaatggcgagaagagtttccagaattcgcagagcaatctgaattccacgaaaacttcactggagaatttcagcagcaatgtgcagacgacactggatggcatcaatcattcgatcaattccatcacaacggatatcaacaacgcgaacctggcgcagaatgcgcagtctacggcagacaatctgaacaagacggcaaccgatacggcggaactgatccgacagttaaaccagttgaagaagagtctggcagatcaggcggcaaattcatcgggaaccacaggctccacggagggcacaggctccacggaaggaacaggctccacggaggatacaggttccacagaaggaacaggctccacagaaggaacaggctccacggaggggagcggttccatagattcgatcgtgtccgatgaggtgaatcagcagattcaggagatcttaaataccttaaacagcatgaacaatggtgctgaggatattcagaatgcattaaatgctttgctccagcagggcggtggtacagacggctccggtcagattgttgcggatatggtgaacagatctgtggcaagcgtgacacaggtgttaaacaactgcagcgagtcgatcaccaatctgaagaatatgtataccaacagtcttgttccgcagatggacggagtgttaaacagtgtatcgcagatgctcggcaatgtgacaaagcttctggataacttaaataccgcagtaaatgatatgggcgtggtgtttgacggaattcagacaacggtcagtgacacgacggagagccttgagcagatccagaccgtgattgacaatgtgagcacaaagctgacggaactgatcaaacggttggagagtgcggaagatgatgaaaaagtagatgcactgctgaagtttttgcagggtgatccggaggattacggcgccttctttgcagaaccggtacaggtgacgacacaggagatctacgcgattgcaaattacggatcggcgatgacgccgttctattccgtgcttgccctctgggtaggaggaacgattctggtggcactgatcaaagtgaagccggataccgcagggctttccaacccgaagtcctatcagttgttcttcggaagatatctgctgttctttgtgtgtgggcagatccaggcggcgattattgttctgggagatatttatctgctccactgccagatcctctatccgggcttattctggctgacggcagcactggcaagctttacctttacgctgtttatctatgcgatggcgctggctttcggcgacgtcggcaaggcggcggcggtcgtagtcatggttatccagattgcaggttccggcggaacgtacccgattgagacgcttccggagatttatcagaagatttatatcttcttcccgttcccgtatgccatcaacgcaatgcgtgagacgattggcggtatgtacggaagcgattatatgaagtatctgggagaactgctgctttttgcggtggcggcgcttctgattggtcttgtgatccggcttccgtttgtgaagatcaatcattttgtagaaaagcgtatggaagatacggaaatgatgtaggaaatgggagattttatggaaaagaaagaaaaatacgaacagatgtatgagatgctcgtgacgtatgagcgcaagattcacgagaagaatcaaaagagaatcagtatcggtttaaagtgtattattattattccgttgatcttcctgttccttctgttctggacagagagcaataaggttgtgtttctgattctgtggattgtatcgctgtttttgctggcagcctatctgattctggtggagtatatggactataaccttcaggaaaagttaagcgagatcaacgacgaggggacacgcgtggattccctcatcggactggagattgataatgttccgggaaatctcagaaatgtgattcagaggattgacgacggattaaactcagaggcggagacccggctgattgagactaaggcatccggggaagaaacgcagactgtggaaaaggcacagactgcggaagagacagagaaacaaaaggatgcggatgcacaggctgtagaagatgcagatgcacagaaagatgcggatgcacaggctgtggaagatgcagatgcacagaaagatgcggacacggaggtgaaggagaatgcgtaatatatttaagatttttttcgccgatgtcaagcgcatcagcaccaacgtggtggctgtcgttgtgatcctgggactctgtattctgccgtctttgtatgcatggtttaatattttgtcaaactgggatccgtacggaccgtccgcaaccagaaatcttaagatcgcggtggcgtcggacgacgagggagtcacaattttagggaacagtgtaaatgttggaagcagtgtcatctctgcgcttgagtcgaacacgacgatgggctgggtgtttacggatacgaccgatgaggcgatcgacggcgtctatgatggaagttattatgcggcgctcatcatcccggagaattttacggaagatatgatcagtttcctcggcggagaggtggatcatccggatattatctattatgagaatgccaagaaaaacgccattgcctccaagatcacacagaaggccaagacggctgtgcaggagcaggtaaacagcacggtggtgagtacccttgcagagaccacgatgaaggtgacgaacgccctctcagatgtggatgcggaagattccgatccggcggagagtgttctggtaagactcaataatttaagcagcgacctacagagttacatcaatatattgaactcgtttgtcagcattatgaattccgcccagagtattgtggaggcgagtcagaccatgcttccgaatgtgaacaacatggtttccaacggtcaggcatccatcaacagcatggagagtctgctggttgcgggcaacagcacggtgagttcgacggcggatatggtgtcgtacagctttgacatgatgaacgattcgttaaataatgtgtcgtccgtcattaccaatgcgttaaaccgtctctcggagtattcccagggcacttctgtcacggtacagggcttatcggcgatgatgccatacgtgaggcagctgtttgatacttcggtatccgggtgggaggatacggcgccggaggatatgcaggcgcagatcaatgcaatccgcacgcagttggatatcatcactgcggacctgacagcgctggagaacaatgccgatacatcgatggagacggtaaggaatctcagtaataaaattgtgacggagattgcaaactgccagaaagcggtcgatggactgcgcaatgattttgcttacaatgtcaagccgaagttagagaacacaatgagctccatgcagcaatccatgattgccgcagcgggtattttagacggcgtagatgccgattttaacggtgtggagaatgcactttccgattatcaaagcacgcttgagcgtggaagcaacagccttggcggatcactgtccatggcgcaggagcttctcgccaagctaaacagcgtcacggcggatctggtaagcttacagcagaatgaccagtatcaggagctgcttgaaatcgtaaagagtaatccggaggagctgggagcctttatttcttccccggtaaatctggagacggtcggtatctatgagattgaaaactacggctcggcgatgtctccgttctacacgatcctcgctctctgggtaggagcgctgattctggttgcgatcatccacgtgaaggtgcatccggttgagggcgtcgaaaatgtgaagccgtaccaggagtatttcggaagatacatgatctttttcctggtggggcagacacagacgcttttaacggttctgggcaacctgttttatattaaaatccagtgccatcacccggtattattctggctggcaggcgctgtggcgagcctggtatttaccctgtttatttactcactgaccgtggcattcggcaatgtcggtgaggcgctagcgattgtggtcatggtaatccaggtagccggtgccggcgggacgttcccgattgagacgctgccgaaggtataccagatgctctataagtatctgccgttcccgtacggcatgaatgccatgagggagacgatcggcggactttataagatggattactggaaggatctcggagcgctcggtatctatgtattgatttcactgtttatcggacttgtagtggcaattccgttccgcaaactcaatcatattatcgagaagaacaaagagggatccggagttatgatataatgaactctgacgagttcatattagaagttcctgcggaacttcagatgcgcaaaaagcagcgcgaagaagatgatatagcaacagggagcagattatgatgcgtttgatacaaatggttcttttactcacggggctgctcatggtggcagctcccggggcatgtacaagaaaagatgaccggggtaagccggagaccgagaagcgcacccgcacgattgggggatggctgactgcggcagcggttatctggatgattacggaagtattgagaagtttttaagttattttgggtattcctaataggtatacccattttttgttcggatattgacaaaaaaaatgtacattgttattatcaatggtaagtgtgatgtgtaatttcagatagtaaggaaggttttcttaaatgagaagacaggtattatcgcttctggtcgagaataatccgggtgtgacgagtcatatttcggggctgttcagccgcagaggctacaacattgacagtttttcctcgggagtgacagcggatccgcgctatacgcggattacgattgtggcgagcggggatgaacagattttagagcagattgaaaagcagcttgccaagcttgaggatgtggttgacattaagaagctggagccgggctcgtctgtgacgcgcgagctgattatggtcaagatacgcgccagagatacggaacgccagccgattttaaatgtgacggagattttccacggcaagattgtcgatgtgacacacgattccatggtgattgagcttaccgggcatcaggataagctggaagcatttctggatctgctgcaggggtatgagatcctggaactggcaagaacgggaagtaccggtctgtccagaggaactgccgatgtgaagatgatcgacgaaaacggacatctgcagagtttgtaatacatactaattgtgaacgagcggcagacatcacagatgctgctgctatgtataaaaaatggaggaaaaagatatgtcagcaaaaatattttatcaggaagactgtaacctttcactgttggatggtaagaccattgccatcattggatacggaagccagggacatgcacacgcattgaacttaagagattccggatgcaaggtcattatcggtctctacaagggcagcaagtcctggaagaaggcagaggagcagggatttgaagtatatacagctgcagaggcagcaaagaaagccgacatcatcatgatcctgatcaatgatgagaagcaggcggatctttacaaaaacgacatcgagccgaaccttgaggaaggcaatatgttaatgttcgcacatggattcaacattcattttggatgtatcgtaccgccgaagaatgtcgatgttaccatgatcgctccgaaggctccgggacataccgttcgttccgagtaccaggcaggaaagggtactccgtgtctgatcgctgtagagcaggatgcgaccggcaaggcacaggatctggcgcttgcctatgcacttggcatcggcggagcaagagctggcgtgcttgagacaaccttccgcaccgagaccgagaccgatcttttcggtgagcaggcagttctctgtggtggtgtgtgtgcactcatgcaggcaggctttgagacactctgcgaggcaggatatgatccgagaaatgcatacttcgagtgtatccatgagatgaagctgatcgtagatctgatctaccagtcaggtttcgagggaatgagatattctatctccaacacggctgagtacggcgattacatcaccggaccgaagatcatcacagaggacaccaagaaggcaatgaagaagatcctctccgacattcaggacggaacctttgcaaaagagttcttactggatatgtctccggcaggaagacaggttcactttaaggcgatgagaaagcttgcttccgagcatccgtcagagcaggtcggcaaggagatccgtaagctttacagctggaacaacgaggctgacaagctgatcaacaactaagagctaagagcggagaatgaatccgcaaaaagaatagagaatctgccgcatggagtgcgaagtgcttccggcggcagattttttatttcataggaaataccgtgatacattcatgtgtgaaagtggaactttcctatgaaataaaaaacgctccgcgaggatgcgcagctcgcggtaaggaaaatatcgctttgcgaaacgcgagcgcgcggagaatctcgcaagcgagattcttttttatgtggatgccaaaatccggttgacaaatacatccagtatgttaaaataaatcatgttcatgcataaaatgaatcaaagtatgtgaccgtgagaaggagcattaagaacggaagaatgacagagagccgccgggtggtgtgagacggtatttggaagttcccaactcgcctttgagtcctttgccggaagccagtggcagcgccagcggtgtgtaaggcagagcgtgtgattcgcgttaagaatgataagtgcgtacctgcgcatagcgcggtgcgaagcagagtggtaccacggagtagcgttacttcgtctcttacggcagatgtcgggagacggagtttttttgttatttcaagcgttaatgaaagatgaggagagagaagatgtcagaactttacaatcacaaagttgtcgagaaaaaatggcagaaagtctgggatgacaacaaggcttttgcggcgacagacgattacagcaagccgaaatattatgcactggtggagttcccgtatccgtccggacagggactgcacgtaggacatccgagaccgtacacggcactcgatattgtggcaagaaagcgccgtatgcagggatacaatgtgctttatccgatgggatgggatgcatttggtctgccgaccgagaactatgcgatcaagaataagattcatccgaagatcgttaccgagaataacgtgaagcgttttaaggagcagttacattcactcggatattcctttgactgggacagagagatcaatacgacagatccgtcctattacaagtggacgcagtggattttcttaaagctgtttaaggcaggcctcgcttacaaaaaagagatgccgatcaactggtgtacttcctgcaaggtcggtcttgcaaacgaggaggttgtcaacggtgtctgcgagcgctgtggagctccggttgtccgcaaggtaaagagcgagtggatgttaaagattaccgattatgccgagaagctgatcgagggactggatcacgtggattacattgagcgcgtcaaggtatcccagaagaactggatcggcaaatcccagggcgccgaggtggatttctccatcaagggcaaggaggataagcttcgtgtatacacgacccgctgcgatacattgtttggtgttacttacatggttgtatccccggagcatccgatcatcgacaaatacaaggatgaactgaaaaactgggatgcgattgcggcataccgcgacgaggcagcgaagaagtctgattttgagcgtgcagagcttgccaaggagaagacaggcgtgcagatcgaaggtctgaccgcgatcaatccggtcaacggcaaggagattccgatctggatttccgattatgttctgatgtcctacggaaccggagcgatcatggcagtgccggcgcacgatgagcgtgactgggaatttgccaagaaattcaacctgccgttaattcaggtcgttgcaaagaacggcgaggaagtagacatcaatgcggctgcatttacagatgtggcaaccggtgttctgatcaattcggatttcttaaatggacttgaggtcaaggacgccaaggcaaagatgatcgcgttcttagaggagaagaagatcggtaccgcgaagaccaactacaagctgagagactgggtattctcccgccagcgttactggggcgagccgattccgatcgtacactgcgataagtgcggttacgttccgatcgatgagagcgaacttccgctgatgcttccggaggtggagagttatatgccgaccgacaacggagaatcgccgttagctgcaatgacggactgggtgaacaccacctgcccgtgctgcggcggtccggcaaagcgtgagacagataccatgccacagtgggcgggatcttcctggtatttcttaagatataccgatccgcacaacgacgaggcactcgcaagcaaagaggcgttaaaatactggatgccggttgactggtacaacggcggtatggagcacacgacacttcatctgctctactccagattctggcataagttcctctacgatcagggggttgttccgtgtccggagccttaccagaagcgtacttcccacggcatgattctgggtgagaacggcgagaagatgagtaagtccagaggaaacgtcgtaaacccggacgatatcgtaagagagtacggtgccgatacgttaagaacctatgagatgttcatcggtgcgtttgatttgagcgcttcctggtcggaagatggcgtcaagggatgccgccgcttcctggagcgtatctggaaactgcaggatatcatgaccaacgaggagggatactcttcggatcttgagacaaagatgcatcagacgatcaagaaggtaagcagtgattatgagaatctgaagtacaacacggcgatcgcagcaatgatggcgctgctcaatgattttacaaagaagggctccatcacaaagggcgagtacaagaccctgctcattctcttaaatccggtagcaccgcatatcacagaggaactctggcagattatcggcggcagcggctatgtatatgagcagacctggccggagtacgaggaagcgaagaccgtagaaaataccgttgagattgcagtgcagatcaacggaaagacgaaaggaacgctggcaatcggaagagatgacgcgaaggaggatgtcattgccaaggcaaaggaatccatcgcagataagctcaccggcaacatcgtaaaagaaatctatgttccgggaagaattgtcaacattgtaatgaaataagatatggaaaaaggaacgaagcttttagaaggttccatctggaaaggggttgtagcatttgcaatccctctcttcttgggaaatttatttcagcagttatataataccgtcgattccctgatcgtcggcaatttcctgggcagcgatgcgcttgccgctgtcagttcatccggaagtcttatttttcttctggtaggattttttaacggaattgccgttggcgcaggcgttgtgatctccaaatacttcggggcgagagactatgagaatctgaaaaaagcggtgcatacggatgtggcattcggacttgtctcaggacttttgctcaccgtgatcggcatgtttttggcaccgcagattctggtgctcatggggacgccggagtcggtactgccgaattcaatcctgtatttccgcatttattttgcgggatcgcttgcatttgtcatgtataacattgtgatgggcattctgcaggcggtgggagacagcaggcatccgctgtattatctgattttttcttcgatcgtgaacattgtgctggatctgctgtttgtcggtgtccttagaatgggcgtcggatcggcggcgcttgccacggcaatctcacaggcggcgagtgcgctgctctgttttatccggctggtgcgcacgaacgatatttatcaggtaaaaatacgggagatccggtttcatccggcgcagcttcggcagattatcagctttggtctgccctccggtctgcagaactcgattatttcgattgccaacatcgtggtgcagtccaatattaacaagtttggcgtgatggcagtcgcaggctgcggtgtgtattccaagatcgaaggttttgccttcctgccgattacctgttttgcgatggcactcacaacgtttatcgggcagaatctgggcgcaaggcagtatgaccgggcaaaaaaaggcgcggcgttcgggattgtctgttccatgacacttgcggaactggtcggcgtgatcgtgtatatgctgatcccgtacctggcggcagcctttgacagcagtgccgaggttgtgggatttgcaacgcggcaggcacacgtggaggcgctgttttactgtttcctggcgttctcacactgtattgccggaatcatgcgcggtgcgggaaaatccgcggtgccgatgttcgtgatgctggtttcatggtgtatcatccggatcacatacattacgataaccgtgcattttattccgaagatccaggtgatcttctgggcgtatccgctgacgtggtcgatcagctcgattattttccttgtgtatttcctgaaagcggactggattcacaattttgaacgggcagaacagagataagaaaatgtagaacatggggaaaaagcgatgaaaaatgggcagaatggctgctggtggcaggggctttatgtatgggtatggcaggctgcggaagtgaagaaaaaaacacgtcgaacgcagatgcagaacagaaaagtgagactgcatcagagacaagagaagaaggacaggcaccggagcagacggatacagaaggaagcgaagaggcagaattacagacaacagagtcagaacatgcagagacgggactcactttcgcagatcttgcagcgctgcagtttgaattttgcagtggtgcaggtggatggtcaacggattttaccattgagaaggatggctctttttccggcgtatatcacgattcagatatgggggataccggggatggctatccgaatggaaccatgtattactgcaatttttcaggacatttcacgaacttaacgaaggtagacgacgatacttatgagatgtcacttgcggatatttcctatcagaatacggtcggagatacagagattctggatgatatgctttatgtttacacggatgtctatggtctggagggaacggataccttccggatctatctgccgggtacgccgagagaaaagctgacggaagacgaatggttctggattgcagcgggaaatgagagcgaaacggaactgacgatgacggtgatcgtcaatgagccgaatgaatatggaatttattcctatgagaggtcaaccgcgtcagaggaagcgcagggaatatataatagtctgttgagctacaacgacgaactggaacagcaattacagagtgcctcaacgcagcaggaaatgaatgagattacggcgcagatgtaccagaatagtgacgatagcttaaaccagatctggcacatcgtgaaatataattcagatgagacagaattctctcagattctggaagaacaaaaaagctggatcacggaaaaagaggcggaggcggaaaagatcagagcggcaaacaatggttcttcggcagagatggatgtcaacataaagctaaatgatctcaccgaagaacgctgcagggaattgttggagtatttgaaaaattaaataaaaagatgatataaaaaaacaggaatcgttctctttctggcatacagggcggaatattcctgttttttgttattctacttggagtagagtgaaaaaatgtggcagatgtagtagaatagaaacagaaaggagagaggatgaatgattgataatgtgacgtttggaggatttgtccggacacttagaaaagaaaaacagatgacacagcttgaacttgcaaagatcctgaatctgtcggacaaaacgatatccaaatgggagcagggaaaggcatttccagacattgcagtctgggaagcgctcgcagaagcacttgatgtgacggtggcagagttgtttgcaggagaaaaactgccaaaggaagagggaaaagtcagtacagctatatttgaggatggcattgcagtggcagcaaatgaagtccggcaaaaaaagaaaagataccggggactgttgatgattatggcggcgctgttagtggtggttgcaggtctgggtatcggcaaaagcctgaaagagaaatttgcagtatatatggtcagcatggatgcaactattcttgaggttcatgaagattattgggaagttagaggaaaggtaacggatgccaaaggacgcagcggagtttatgacatcagtctgacagaaccatggtatctggagcacccggtggatggtaaggaaggagatgagatccgctttttttaccgggaggattggaaaaatagaactttgaaagaaaacgaatatatacaagggattttttctatggagaaagtggaggatgagtagaatcgctagttgggctataaaagaaaaaatctccgctgtttatttgcaaatagcggagagtttcctttaaaaattctgatagaactgaatgaactcattgagcgatttggaaggtttgctgttggtgcggtaggcgaaaccaacctcgcgcttgtgaatcggaatgccgagtggaatctccacgagggcaccggaggcgagatcgtcctgcacgaagcttttgatgacgcaggcgacgccgacgccgatcctggcgaaatcaatcagcagatccatgctggagatatcgatggaatcgtgaacaacgatatgattctcctgcagataatcgtcgatgtactggcgtgtcatgttgttctggtctaagagcatcagtgtggaggatgtgaggatctcgtctttgcggacgccacgggcatgcagattgcgcagatagtctttggtcgccacaaaaatatcctcgatctcttccagatagtcaaaatgtatattctttacattgtccggcttcccgatcagaccgatatcgattttgtcatcctcgagcagctttaaagtgtcgttcgtggattgacagtggatggagatcgtgatatgcggattctgccggatgaattcctttaagtagggaagcagcatgtatttgcaaagggttgcggagacaccgatcttcaagtgaccgaccccaagctcaatcgagcgctttaacttttcttccccgagtgtgagcgtctcaaaggcagtcttgacatgctcgtagagcagctgtccctcgtcggttaatactacgccgcgggaactgcgggaaaagagacggcagccgacgctttcctcgagcttctggatggatttgctgatggcgggctggctgatgtaaagctccttggcagccttggagatattgcctgtgttggctaccgtataaaaaatccgataggatgaaagattctggttcataatagttcctttccttgggggtgttgatttcatagatatttgtatctgttctgacaaaagtatatcatgaattaatgttatggtaaatatatttattatgtatttttattatagtatgtgctatgataaaatagtcacgaatcagatgaatattacacacacacgaaaatagagtttgatagtaggaggggatagaatatgggtatgacaatgacacagaagattcttgcggcacatgccggacttccgtctgtctgtgcagggcagctcattgaggcagatctggatctggttctcggaaatgatattacatcgccggtggcgattcatgagatggataagatgaaggtggacggcgtttttgacaaggacaagatcgcgctcgtgctggatcatttcgtgccgaataaggacattaagtctgcgcagcactgcaaatgtgtccgtgaatttgcctgccgccatgacattacgaattattttgatgtgggagagatgggaatcgagcacgcgctgcttccggagaaaggactcacggtggcgggagatgtcatcatcggagcggattcacatacctgtacctacggggcgctcggcgcattttccacaggcgtcggcagcacggatatggctgccggtatggcaaccggaaaagcgtggtttaaggtgcctgctgccatcaagtttaacctgaccggaaagccggcaaagtggatcagcggtaaggacatcatcttacatatcatcggcatgatcggtgtggatggtgctctgtacaaatccatggaatttgtcggggatggcatacagtatctttccatggacgaccgttttaccattgcaaatatggcgattgaggcgggcggcaagaacggcattttccctgtcgacgatctgacgaagcagtatatggagaagcattctaagcgcccgtatgttatctatgaggcggatgaggatgccgagtatgagcaggaatttacgattgatcttagcacgttaaagccgacggttgcatttccgcatctgccggagaacacgcacacgatcgacgaggtgggagagatcaagattgaccaggtggtcattggctcctgcaccaacggcagaatggacgatctgcgcgtggcggcatcgattctgaaaggacacagggtggcaaagggactgcgcgtgatcgtgatcccggcaacacagcagatttatctggatgcgatggaagagggtttgttaaagacctttattgaggcgggggcagtcgtttcgacgcctacctgcggaccgtgtctgggcggttatatgggtatccttgcggaacatgagagatgtgtctccacgacaaaccggaactttgtcggcagaatgggacacgtggagtctgagatctatctggcaagtccggctgtggcggcggcaagcgccatcaccggaaagttatccggaccggatgagattgcataggcgaggaaaggagacagagcatgaaagcagcaaagggtcatgtatttaaatacggagacaatgtcgatacggatgtcatcattcctgcacgttatctgaattcttctgatccgaaggaactggcgacacactgcatggaggacattgacaaggattttgtgaaaaaggtaaaagcgggcgatattatcgtagcaaataagaactttggatgtggttcgtcgagagagcatgcaccgatcgccatcaaggcttccggcgtgagctgtgtcatcgcagagacatttgcgagaatcttctaccgcaacgcgatcaatatcggactgccgatcatcgagtgtccggaggcggcaaaagcgatcgaggcaggagatgaggttgaggttgattttgactccggcatcatcacggacaagacgaagaacacttcctatcaggggcaggcgtttcctccgtttatgcagaagattatcgactgcgaagggctggttaattatatcaatcagaaatagaattaaccttttgggcaatctgttccagataattcagatagcgcctggagattttaagaccggtgtagatatctgcgtattccttcggggagagcgtatcgacatagttttccgggaaatttttttgaatgcctgccgcgcgggcgagatcaacggccttgttgtaggcaatggcggctttttcctcggaggagtagctgccgatctggtaattgccattgatgtggatgacggcgcggtaccgcgggagtccgttctttaaaaactggagcaccccgtggtaacggttgacgatcacaatattggaatagcggaagtcacttttatctccgttgacaaactgatagtctcttccggcaacagcgtaagggcggatgccgtagcgggagaggatggaatactgcatgccatagtcgctgacgaacagatgcccctgccgtttctggatcttgcggctggaatagtagaacaggtcgtcaacgtcaaactttaactcctcgatgcgcgagagatagtagctgaaatagccgttgcgcaggtagatcggattcttaaagtaaatgccgttgttgcggaagttcaaaagcacgatgattttttcaaaggagagggttgtgggctgctcaatataatcttccggcagctgatccaaagagcccagaatggcaagtgcttccagataggcattgcctgcggtggtctcatccgcatagcttccgagactgatatgtttatttttgtaatagagaccggcacggtagtagaccgtgccgtctttttttgtggcgatggatacaccctgcgtcataggtcacctcttgtttaccataaaaatattatgtaaataagcattaggatacacttttgtgatgagtatagaataacagaaggaaagacgggatgcaatagcggaaatccgattgacgaaaatatacaattttgctatactaagaagagttagatgtgtgcaggatgtcatatattttggaaggggccattcttaaatgaaaaaaatatcaacaaaagtattgatcccggtagtgctgcttgcagtgattgcagtcatttcggcggtaaccggattaaaaaatgccaatgagctgcataccagcagcaaggagatcagtgacacaacggtgaatcagctgatgctgttaaatgacatttcgtcgaattttaagagcattgatgcaatcacataccggatgtgcgtgtccacgtccaaggacgagcgcgatcagctgatggagcaggtggatcagtaccgcacggacattcagacgtcgattgattcctatgaggcgctgacacagacgcaggaggaagctgcggcaatggagacgcttcgggagaattttgccgattacaccgaggtctatgaccggattgcagactttatttcccgcgggaataaggacaaggcgagacagatatgcaatacggtgctggcgccgaccagcgagaatgtggacggcgtgctcacggagctggaagggtatatggaagcaaatgtggacgccggcgtggcggagcaggaatctgtatacaataattcgcgggcagtcagcggcgtcacatttgtacttgtgctggtgttctttgtcgttgcggtgatcggatcggtacgcactgttgtaaatccagtcaagagtgtgacgacacagctgaatgatattttaaaagagatcgagtccggcaacggagatctgacacgcagaatctctttgaagaacaaggatgagatcggacagcttgccggcggcatcaacgtgttcttagagaccctgcagcagattatgagccgtattgtgattgactccagggagatgggcgagatcgtatcgcgcgtttcgggcagtgtcggcacagcaaactccaatgcctgcgatatttctgccgtgatggaggaactctcggctaccatgcaggaagtggcgtctgccgtcaacacggtcaataccaatgtggcgcagatcgggcaggatgtgaatgagattacaaaagaatcacaggatatgaactcctatgcgaccgagatgcagagccgcgcggaggatatgaaggagaaagcggttgccaacaaggagacgaccagccggatgattacggatatcatcgagactttaaaggctgccattgaggagagcaagagtgtggatcgcgtcaacgagctgacggaggagatcttaagcgtatccagccagacgaacctccttgcactgaatgcttccattgaggcggcgagagcaggcgaagccggaaaaggatttgcagttgtcgcggatgagatacgaaagctggcggattccaccagagagaccgcgaacaatattcagtccatcaatgcgctggtaacgcaggcagtgaataagctcgccaacaattccaacgcgatcgtcgaatacatcgacgggacgatcatgccggattatgaccgatttgtagaaaacggcgtacagtaccgggatgatgcggcgtatgtgaacaccacgatggatcattttgaggagaaggcgcgcaacctgcagcagatcatggagaagacggtggattccatccgcgacatttccacggcgatcgaggagagtgcaaacagtgtcggaaatgcagcgagcagcacgacggttctggtgtccaatatcgacaccgttcattcggagatggagacgaatcagagcatcagcgaccgcttaaagggagaagccggacgatttaaaaatgtataatattttagtacgttagtgcattgacatgaatgtacagtttcttatataatgtgagttaagtatataagagactgtacattttttttgtacatcgcatgttacaagaagaaagagataagaggattatgaagatggaattagtgtatgcaagtacgagagacgcacaggaaagagtaacggcatcgcaggcgattctgcgtggtctggcaaatgacggaggactgtttgtaccgacacagattccggcgctggatgtgccgatggaagagcttggcaaaatgtcctatcaggagacagcatatgaagtcatgaagcgttttctgacggattttaccgaggaggagttaaagcactgtatcaattccgcgtatgacagcaagttcgacacagaggagatcgcaccgcttgtggaggcggacggcgcatattacctggaactgttccacggttccacgatcgcttttaaggatatggcactgtccattctgccgtatctgctgacgaccgctgcgaagaagaatcatgtaaagaatgagatcgtgattctgactgccacctcgggagataccggaaaggcagcgctggcaggattttccgatgttccgggaacgaaaatcattgtattctatccgaagaacggtgtaagcccgatccaggagaagcagatggtgacccagaagggtgacaatacgtttgttgtcggcattcacgggaactttgaccaggcgcagactggcgtgaagaagatgttctcggatgcggcgctggcaaaagagatggacgctgccggatatcagttttcctccgcgaattccatcaatatcggaagacttgtaccgcagattgtgtattatgtctacgcctacgcgaagctctatgcgaatggcgtgatcgcaaaggatgagccggtgaatgtcgttgttcctaccggcaacttcggcaatattctggctgcattttatgcgaaaaatatgggaataccgattgccaagctgatttgtgcgtccaacgagaacaaagttttatatgatttcttctccacaggcacatatgacaagaaccgtgagtttatgctgacaagctcaccgtcgatggacattctgatctccagcaatctggagcgtctgatttaccgcattgcgggaaacgacgccgagaagaatgccgcgctgatgagagaactgacgaccaccggaaaatacgagatcacgccggagatgagagcacagcttaaggatttctatggcaattacacaagcgaggcggagacggcagaggtcatccgcgcactttatgagaagacaggctacgtgatcgatacacatacagcggttgctgccggtgtatatggaaaatacaaaaaggataccggtgatgtagacaccaagaccgtgattgcgtccacggcaagcccgtttaagtttacaagaagtgtgatggatgccattgaccacaagtacgacagcatgtccgattttgaactggtggatgagctgagccggattgcgaacgtagccgttccgcaggcgattgaggagatccgcaatgcgaaggtgcttcacgataccgtgtgtgaagtggatgagatgccgcaggtagtaaagaatttcctgaaaatctaagaataaaaatgtgaaagacataaaaaagctgcacgccccgcgcgtgcagctttttttgataaatcttttttgataaacttatttttcggaacagatttcaaagatgaagtgaagcgttccaaacgggaataaaaccggcagaagataagtctcatgctcaaaggtaagcagatctttttcttctacaaccggagcctccagtgacagattcatggagaactcgtttgacatattgacacagaacagaccgttgtgcagattgataaaatcttctacagaagaacgcacatactcatcaaattctgtaaagttttcgttgacatacttggatgcaaaagcaatacatgtattctctggaatatcgagataagtccggatggaaaacgatccgcttactttctgtgatacgcagtagttggtcgggtattccttgcaactgctcggagaaaccagtgtgaaatcatctccgataaaccgatagagattattgaacaaaagctggaaaaaagagatttcatactttgagagcggacgctcagcgagaatgaaaaagttctcgatcatatggcggatggcatcctgatcttcctcggagtaactgtaatcgtccagttcgttctctgactgataatcaatgatcaactcctgcagctgctgattattgatgagtccttcgtccacaagtgcctgtccgagaagaagaaaatccggcttctgctctgcgagaagcttagtcacttccgcctctgtgagatatccctcatgaatggcgagttcaccaaaacgcttgtcctcgtgtgtctgaagaatgacgatacggtctacctcgtttgcggtcatatatccggcatgaatggcaagagtgccaagtttgatcttggttgaagacttccgatgcatggtttctaacagctgctccctggtaacgacaccgtgtgataataagtaatttccgaaaaactgagcgtacatagcttatctcccttcaaatcttgaagaaataatgtgatgaatctgttctgcattcagcggcttctggataaaatcgttagccccggcttcaatggcagcttttaactgtgtctgagtaccgacggatgaaacgacaataatatcagcatccttatcatatgccttgatctcggtaatggcagcaatgccgtcctttacaggcatgacaatatcaaggaaaaccaattcaggtgactcttttttgtagaggtcgatggcgtcctgtccattggaagcttccagaaacaccggagtaccatatgtggaaacaatatcctttaactgctttcttgcaagtatggagtcgtcgccaatgagaatcttaatgccatttaacatcataatgcatctcctctgtcatcataattatattcgcttctattttacactaacaagaaaaatagttcaatgaatatattgaattttgtaagaagaagatagataatgtaaaaaaatatgtcgaatcagtcgactggaatgagaggatacaagaatggacgtaatgctgatatttgatgtggtcatcgccattttcggggtatatatgatcgcagcagcacttaagatgaaaaagaccgggaagatcagctcggcggtcatcacggcggaggagattgccagatgcagaaaaacgaaggagttcatagcgtttatttactggaaagaggcagtgttcggcgcattgattatcgctgtgggtgtccttggaattatcaatgataaagtggtatcgctcggtgcatttaacgtggttgaacttttaatcttcctggcggcatttctgtggttccagtcccagctgcgcaaggcaagggaacagtttttataaaagattctccgaatcatcagatggcattcgcaggaacgtcacattgcgacgatatgatgtcaaaaacagggaggtatctgcgttatgagaagaatactggtagtagatgacgaagaaaaaatcagggcgattataagaaaatacggagagttcgatgggtacgacattaccgaggcaaaagacggcatggaggcggtaaagctctgcagagagcaggattttgacgtgattattctcgatattatgatgccggagctggacggcttttcaacctgccgggagatccgcaagaccaaaaacattccggtgatcatgctgtcggcacgcggagaagagtatgataagattcacggatttgaacttggaattgacgattatgtggtgaagccgttttctccgaaggagcttatgatgcgtgtaaaagtggtcattgaccgcaacggcggaagagattctgcaagcacgaacgggcatgagattttccaggcggaggggcttgtcattgattttaccggaaggactgtgacggtggatggaaagcgcgccgaactttctccgaaagaatacgacttgctgttttatctggtgcggaaccggaatattgcactggagcgtgaaaagctgattaccgaggtgtggggatatgattattacggggacgaccgtacgctggatacccatatcaagctgctgcgcagcagccttggggactaccgcaagttccttgtcacgttaagaggggtggggtaccggtttgaagcatgaaaaaatcagtatcaaatggaaaatctttttctatcttctggtgtttaccggaatccttttgacggtgctgtggcttgtgcagatctgttatctggacaagttctataagaagatcaagtcccaggaggcactggaactcacctcggaagtgattgcggtcttacagagcgattcccagaacattgaagaacagatcgatgcgctggcggcgcagaataacatgatcgtgtttgtcacggatacggacgggaataccatttacagcgcggaatatatcccgaattccaggctgtgcgagatgccgcaggagatgatacagaagctgtacgaagctggaatttgagggagatatcgggaagaatgattttcagaatccgcaggacgtgatgaatcccgatgcggcagctgatgcggcgggagccggaaatatcccggatgcagccgatgtgacaggagcgggagcagaaaatgccccggatgcggcagcgggtgccacaggagcgggaaactccccggatgcagccgatgtggcaggggcgggagcagaaaatgccccaggtgcagccaacggcgcagagcaggagactgcaggaatgccggcggagaacggttttatgcagaatcacggacaggaacggattgagagcgtcatttacgtgaacgtcgtctcgatcgatggaaatgagagaatcctgtttgtgaacgcgcagctgacgccggtggatgcgacggtcaatacactgcgtgccgaactggtatggatcacagtcatcatgattgttctctcgctcggtattgcacttttgatttcaagaaaagtgtcacgttccctgatcggtctgaatgcctccgcgaaggagatggcaggcggcaattttgacgttcattttgacggaaccgattaccgggaggtcgcggaactttccgataccctgaatatgactgcgcgggaacttggaaagagcgagcgcctgcggcgggaattgatcgccaatgtatcgcatgacctgcggacaccgctcacgatgatcattgcctacgcagaggtcatgcgtgatctgccgggggagaattctccggaaaatgtacaggtggtcattgacgaggcggagcggctgaccaatctcgtcaatgatatgttagacatctccaagcttcaggcaggtgtaatggaaaaaaatgtcacggtctacaacctgaccgagagtattcagtctgtatttgcacggtataataagttaaaagagcaggatggttataagatcgatttctcctacgaccagatggtcatggtggaggcggacgagtacaaaatcttccaggtcatctacaatctggtcaataacgcaatcaattacaccggggatgacaaacagatctgggtgcgtcagattgtgcgggaagacggatatgtgcggatcgaagtgacggacagcggcgagggaatcgctccggaggcgcttccgtatgtgtgggaccgctactataaagtggacaagacacacaagcgggcggtcatgggaaccggactcggactttcgatcgtaaaaaatattctggaactgcacgatgcacgctacggagtagagagtgaagtgggaaaaggttctaccttctggtttgaactgaaagtatatcagattgtttaaaagagctgcccgcggattgacggagcgggcaggaggaagcatgtggcaatatgcgaacttagaactccggctataatggccggcggttcttctgatcgtaaaatccggtgtttctaatcacaccgcgtttgacatccctgatgatccgtgtctttccaagtttggagcactccgccggatgagtccgcacgccacagacaattttagagctttcgtgtggcgcttataccgctgctgaacaaaacataatcgcgcgaagccgatgtttgaattggcatctgccatattttcaatagcagatgccaacgagtttcggttcgcgcgattttatattgtctgtgaagcagcggcattagcgccactaggaaggtcgctcattgtctgcggcgtgtcggacacagccggcggagtgttcaaacgtggcaaagacacagaataagatgtcaaacgcggcatgaaagaaacactcgcattttcctctaaagaagagccccgtccattacagacggagttctctcatctcgcgtattttccatagtattccattttgtccgctccgtcagtccggggcggcttttttagaacaaggcgtgcagtgaaaatcagacacgctcatccatcgggacataaatcttatgctcgccgacgtttttgtaggcaggacgcatgatcttgccgccgcctgcaacttcctccagacggtgcgcactccatccggcgattcgcgcgatggcgaaaatcggcgtgtagagttcgaccggaagtccgagcatgctgtaggcgaatccgctgaagaagtcgacattcgggctgacacctttatagatcttgcgctcggcggcaatgatctgcggggcaagacgttccactgccgtgtagagtgcgaattctttttcatagcccttttctgcggagagacgctttacgaatccgcggaagatctgtgcacgcggatcggacagcgaatagaccgcgtgtcccataccgtagatcagaccggcgtgatcgaacgcttccttgtggagcagggcagtcaggtaacggctgatctcctcctcgtccgtccagtccttgagattggccttcatatcgtcgaacatgcgcaccaccttgatgttggcaccgccgtgcttgggacctttgagggaacctaacgatgccgcaataacggagtatgtatcggttccggaggaagataccaggtgggtggtaaaggtggagttgttaccgccgccgtgttccatgtgaagaatcagggcaatatccaaaagctttgcttcaagcggcgagaacttgctgtccggtcttaaaatgtgcagaatattttcggcggtggaatattcttccttcggggaatgaataaacaggctcgcgccgtcatgataatgcttgtatgcctgataaccgtacacggataaaagcgggaaaagactgattaactgcagacattgtctgagaacattgggaagcgaaacatcatccgccatctcatcgtaagaatataaggtaaggacactgcgcgcaagcgtattcatcatgtccttgctgggcgccttcataataatgtcacgcacaaagctggtcggcagcgtccggtaactgctcagcagagccgaaaagtcgcgcagctcatgcttcttgggaagcttgccgaaaagcagcagataggtacattcctcaaagccgaagtggctgtcctcgggaagtccggcaatcagatctttgacattgtaaccacgatagaagagctcgccgtctgcgggaacagattcaccattgacaatttttgtggaactgacttccgagatctccgtcagtccgaccaggacaccttttccgttcagatcgcgcagaccgcgtttgacatcgtatcttgtgtataattccgggtctatttttgaacattcggcagactttgcggccagccgacgcagttcgggtgtaatttcacagaattgattcattgttagccctccttaatgttttcgtcttttcatcatagcatatgtacttatttttatacaagaaaattgaattatatttaatgaaaattttaaaatttaaaagaaaactggtaccttaaaaagggaaagtaccaaaaaatgctttcttttttcagaagagtctattacaataaaaaaggatcatcagatgtaaaaagggaggatacaggatggatctgaatatagagttgctggcaaaaaaggcaatcgaggcaaaggaacatgcgtatgtaccatattcccatttcagggtaggtgcggcgcttcttactgcagatggtaagatttatacgggatgcaacatcgaaaatgccgcgtacacaccgacgaactgtgcggagcggacggcgtttttcaaggcggtatccgaaggggagcgtgattttacggcaatcgccatcagcggtgacgcggacgattatctgtatccgtgcggcgtgtgcagacaggtaatgtcggagttctgcaaggcggatacgtttcagatcatcctggtaaaggaggacggaacatataagatttttaccttggaggagcttctgccgggcgcttttaccgagacagagctgaaaaaaggacagcggatgtagggcgtccgcaacagaggaaggagagcgttatgagatattcgattgagggagaaccgcttccggttgtaatctgcaatctggagcagggagaggtaatgattacagagagtggtgccatgtcgtggatgtccccgaacatgaaaatggagacaactggtggcggcatcggcaagatgtttggaagagcgctttcgggggaaagcattttcttaaaccgctacacggcaatgaacgggaatgggatgatcgcgtttgcatcgtcgttcccgggatcaatccgggcgtttgatattgtaccgggacaggatttgatcgtgcagaaatcggcatttcttgctgctgtatccagcgtggatctgtccgtgttctttcagcagagaatcgggagcggacttttcggaggagagggatttattatgcagaagctttccggaagtggaaccgcatttctggaatttgatggttatattaaagaatatgaacttgcatccggacagcagattgtcgtggacacgggttaccttgcggcaatgacaggatcctgtaagatcgaagtgaagacggtaccgggagtgaagaatatgcttttcggaggagagggtatttttaataccgtgattacgggaccgggaagagtgtggctgcagagcatgccgattgcgcagatggcaaatacgctgcgtccgtatttcccgagcaataatcattaagatgtgatgcacattctgcattcagaaaaaaatagaagtgtgcacagaatttggcactaatttttggttgcagatcggggcatattaaagtataataaaaccagtaagaaacagcctgggatgtgcgacaccctacatttttgaacctacatttacttttatgggattcttatatttggaggcagatgtcaagccaccagtaccgcaaggtacgcgagcagtggaaggcagaaaccgacatgcggttacccacctagctatagctaggagtcaaaaacgtaggaaacggcattttgggtgatacaaaagattccgagagatacaacagaagcttacagtacgagagagaacctgtcaggatacgaaggatgacggatacgaaagatagatcaggtaccaaagagttgaaaagttacggaagaaagaagctgcctttgtgtgaggcagcttctgtttttttactcttttgcagagaattctggggcaaggcataaagcgtgatgggaagtggaaaatgggaaagagaacaaaaaagagaggcgtaaaggcatacatcgccatcgtatgtctggtgcttttgcttgcggcgggtgcgcttgcgtctggatatcgggacagacagttaagggagcaggaaacattgcccgaagagtgggtggaacttgcggaaataaaagaagaactctcctttggagtatacgggcaggaagactggaattccttttttgagacgttttcaggagacaggctgaccggggaaatactgggagaactgctcgcaaagctgcagctgtccgattacatagagatccccgtcatgagggaatcgcagaaagtgtcaagggaagactggaattacgtctacggtcagattctggatctgctcgatatggaatatgccgtgacgaaaacggagtttctggttgtggatgtcatggaggcggagaaccagaatgtgattatgacgaataagggagatttttgcacggtgcttccagcttcatattttaagcagtggaacggatatgagggctactgcgtggaaaaccggtgcatcggagtcgcgggaacgctgaagaaggaatttacgctggacaacacatatcttacggactgcaccaaagacagcgtggattttctgtatgcgggcgcggtgtaccacaaggagacggcgtccctgacagagggcgtttccccctgtgtatgcgatattgtgctggcggacggggaacttacggcactgcgtgtaaagcaggagaccatcgagggagaactgttgtcctatgacgatgagaccatcgagatcaaaggatacgggaagctttgccataccggaaaactgccagtgtaccagacctatggggaagtgtcggaaaaatccatttccgatgtgaccctcggcaatatgaacgtggagtatgtgacgggggagaagcaggtctgcgccattttaatccgcgagccggctgtcatccgcgaaatccgtgtgctgctcctgggggatgacggaacaaaatgccggcagtccgtctatctgaaatgtacgtcagacgcagcggtcacctggcagggagagacaacacatgtggcagcgcagacgctgattgctgcatccgatcagatgacaggagatacacagggaacatttacggtgacgccggagcaggagggctgtgtggtgatctgcgatgcagatggcgcagagatttccaatggctacgggggcagcatggaagtgcggtgcatgggagacggctatacgctggtcaacagtctgccgctggaacggtatctgcaggacgtcgttccgagtgaaatgccggcatcctatgaaccggaggcattgaaagcacaggcggtctgcgcgcgcagctatgcctgtatccagctgcttcggggcgatctggcggaatacggcgcacatattgatgacagcaccgcgtatcaggtatacaaccgggtgacggacgcggacgcagccagggaggcggtaatcgccacacagggggaagtgctgtcctatcagggaaacatcgtggaggcgtattatttttccacgtcgatgggatacaccgccgcagccgatgtgtggaatgtggaagatccggcggaatacggctatctgacaccggcgtgtctccttacggatggaaagatgcaggatctctccggggaggaggcgtttcttgcttatattcagagtcccgcagatggatacgacagtgactgccggtatttccgctggagagcggaggcggattaccatgggaaaacagatgaagtgaattccatactgctggaacggcggaagagttcgccaaagaatataatcttttatcaggacggtcagactacggaaatacagaattccgatgcggcatcagtggcggcactgggggaggtgaccggcatgagcgcggcggagcgcggcagctccggtgcactgcttgccttaaagatcacgtatgagaagggaagcgcccttgtgcggacggagtataatatccgaaaagttctggggatctgtaccgcaaaactgacatgcgcagacggcgcggaacagacggatgtgacgatgctgccgagtgcgttttttgccataacgaaacaggaggacggcggcatggttttatacggaggcggctacgggcatggactcggcatgagccagaatgcggcgaatggaatggcgaaggcaggaatgaattacgaagagatcttgcaatatttttataatgacgttaaactggaaaccatgaaataatgaatcctgacggattcgctttttgaaggggagcaatatgatctggaagcttattggtaatgtcaaatcctttcttgataaatgcaagagggataagatcaatgcctattcggcgcagtcggcgttttttattatcttatccatcattccgtttctgatggtgttctcgtctctgctgcaatatacatcggtgacagagtccatgctgcttgagatcatccgtcatctgatgccggagtatgtctctccgtttctgatatcgctcgtggatgaggtgtacagcagatccatgggaattatctcaatcacggcgatcatcgcgatctggtcagcggccaagggcgtccagtacatgacggacggactgaactcggtcaatgatctggaggagacgaggaactggtttgtgctcagattctgggcggtcgtctatacggtggtttttctggtggcgattgtttttaccctgctggttctggtgttcggaaaccagttaaaggtacttgccacacagtacgttccgattttagagcatgcctcgcgggtgctggcacatttccgcgggcttgtgatgctggcgcttttgattgcatttttcgatgtaatctttacggcgctgccgaaccggaagctttccttccgcgggcagctgccgggggctgtgatctgcggggtagcgtggtatgtcttttccttcggactgtctgtctacgtggactattttaacggtttttccatgtacggcagcctgacgactattgccttgattatgctgtggctttacttctgcatgtacatcatgatgatgtccgccgaggtaaatgtggtgttcaacgcttacttccgcaaatggtggaagcgctttaaaaccagcaggaataaaaaagcttgatgttttgcgcctgctgtgctaaaatgctatacagaattcagaaaaatcaaaggctgtgaatgtgtacggaagcgattccgggtatcgtaagatatcagtagagtgcaggagactctttcagagagagcgggtcatcggctggaagcccgtttaggataagacctggacttgaagttcgcacaggagctgcatctgtgaagtgaaagtagtggatgacgtcggatacacgttacgtatgaattgagagcttttctttggtgatatgaagagaagaaacagggtggtaccgcggaatcattcgtccctagagcagggatggatggttccttttttgatgtctgaaatagtttaaaggagaattagaaatgaaagaaaaattgcagcagatcagagaaaaagcaatagcagagattgaagggtctgatggattagaccgcctgaatgaagtccgccaggcagtgcttggaaaaaagggtgaacttactgcggtgttaaagggaatgaaagacgtagcgccggaagaccgcccgaaggtcggacagtgggtcaacgacacccgcaccgccattgagacgatcatggaagagaagatgaaaaaactggaggctgaggcgctccggaagagatatgaggcggagaagatcgacgtcacaatgccggcagtaaaacacgaaaagggcaatctgcatccggtcacacaggtgcgcaaccagctcattgacatttttgcatccatgggatttgaagtgtacgagggaaccgagattgagaccgactactataacttcacagcgttaaacacaccgcaggatcatccggcgagagatatgcaggatacattttacctgtcaccggaatttttactccgcacccagacatctgccggacagattcatgtgatggaggcgaagaaaccgccgatcaagatcatctccccgggcaaggtgttccgttccgatgacgacgcgacacattctccgatgttcacccagatggagggtcttgtggtagacaagggaattaccctctgcgatttaaagggaatgttagatgagcttgtgaagaagattttcggaaaagagacgacaacgcgtctacgcccgtcctacttcccgttcacggagccgtccgtcgaggtagatgtaagctgcttccagtgcggcggatgcggctgtaagctctgcaagggaaccggctggatcgaagtgctcggagccggcgtcgtcaacaataaagttctggaaggatgcggcattgatacgaatgagtacagcggttttgcgttcggtatcggtattgagcgaattgccatgttaaaatacggcattaacaatatcaagctgctgtttgagtcagatcttcgcgtattaaagcagattgacgattaaagacgaatagaaaaggagagttatcatgttagcaccattaagctggttaaaagattatgtagatattgatgttaccccgaaggaactggaggaaaagttgttttcctgcggctttgaggtggaggagctgattgaagtcggaaaagacatcagcaatgttgtggtcggactggtggaatcctgcgagccgatcccggatacccatttaagtctctgccaggtgaatgccggagagcacggcaccttccagatctgctgcggggcagacaatgtccgtgcaggaggaaaatatccgctggcgcttgtgggcgcaacagtctatgcgaccgcaaaggatcatgtgacgatcgagggcgtcatgacgatcaagaagggaaagcttcgcggctatgaatcctacggtatgctgtgttccggaacagaactcggattgaacgaagatttatatccgggggcaggatacaacggtcttttagttcttccggaagatgcgaaagtcggagcagacgtaaagccgatccttggaatggatgactggatttttgatattgcgatcaccgcaaaccgcccggactgtcagagcatttacggaattgccagggaagtggctgcagtgctcggaaaagagtgcagggagccggcgttggattacacggagacggcggttaaaaaagactttaaggtggaagtagccgcaaaagatctctgcccgcgctatatcgcgcactatgtccatgacgtgacgattggggagtccccggcgtggatgcgcagaagactggcgttagtcggaatcaactcgatttccaacatggtcgacatcacaaactacgtgttaaaagagctcggacagccgatgcatgcatttgactatgcttatctggagggcgatcagatcaatgtcagacgtgcaaacgagggcgagcgcattgtgacgctggatgaaaaagaatttacgctcaattcttccaatcttgtcatctgcgacggcgtaaagccggttgcactggctggtatcatgggcggtctgaactccgagatcaaggacacgacaacggaagtcatgtttgagtccgcaaagttcgcgcgcgacaatatccggaagagttcaagagcgctcggacagtcctccgattccagtgcgatgtacgcaaagggcgtctatgagtacacgacggtcatggcgatgaagcgtgccctgcatcttgtggaagaactgggatgcggaaaagtgtcgtccacacagcttgaagtctccaccggcaattctatcgagccgaaagagatgaaggtcagcgtaaagcgtgtcaacggtgtgctcggcattgaggttccggaggaggacatgctgcgcattttatcggcgcttcagttcgcaccgtccatcgacggggatgaacttaccctgcagattccggcataccgcgaggatatggattcctacccggatgtggcggaggaagtgatccgcatgtacggttatgagcatgtgattccgacctttatgccgacggcaaaagtgaccctgggaggtcttaacttaaagcagaagacggagcttaagatcaagcgggcactctgcgcagcgggcgcttacgagggagtccattactcattcttctccccgtccgatctggatctgttaagactgccggaagacgcgccggagagaaaggcgatcaagctgatcaatccgatcaacgtggatttatccctgatgagaaccacgctggcatccgagatgctgtacgcgatttccagaaaccagaagaagggaattctggagggacgcatttttgagcttggaaatgtctttattccaaaggcactgccgctcacggaatacccggatgagagagagaccctctgtgcgggcgttttcggagaaaaggaatccttctatacactcaagggtctggcggagacggttgcggatgcattaaacgtaagctttacctatgaggcggcggagagaacctttttgcacccgtaccagacggcggagatcttctgtgagggagagcgcgtcggttatctcggaaagctttcctatgagattcaggatgaacttgacatgcgtgtgcctgcctatgtgatggagattgacctcgcggcgcttaagaaatggtatggcaaagagcagattttcactccgcttccgaagtttgcggaggaaaagcgcgattttgcgtttgtggtagataaaaatatcacctgtgcacagattgagaacggcatccgggaagcctgcaaatatgtgacagatgtgaatctgttcgatgtgtatgaaggcatccagcttggaccggacaaaaagagcatggcattctctgttgtatttaccccgcaggaggaagagctcacgggcgagatggtagaaggatttgtgaagaagattttgaaacatctcgaagcaacactggatatcagacttcgtgcgtaagaggagtagttatggacgtaaaagatttttattatgaccttccgcaggaactgatcgcacaggatccgctggaggaccgctcaagctccagactgatggtgcttgacaaggcaaccggagaggtggaacaccgccattttaaggatattgtggactatctaagaccgggtgactgccttgtcatcaacaatacaaaagtaattcctgccagactgtacggcgtgaaggaaggcaccgaggcaaagatcgagatccttctgctcaagagaaaagaaaacgatgtctgggagaccctggtcaaaccgggaaaaaaatgcaagatcggaaccagaatcaatttcggtgagggacttctgaccggcgaggtcattgacattgtggaggaaggcaaccgcctgatccagttccattacgaagggatttttgaggagattctggatcagctcggacagatgccgctgccgccgtacatcacacaccagctgaaggacaagaaccgctaccagacggtgtatgcaaagtatgacggttccgcagcggcgccgacagcgggactgcattttacaccggagcttttagagcaggtgcgcgccatgggcgtggagattgcggaggtgacgcttcatgtgggacttggcaccttccgcccggtcaaggagagtgatgtgttaaaacatcacatgcattccgagttctaccggatcgagcagtcggaggcggacaagatcaaccgggcaaaacaggagggacaccgggttatcgccgtgggaacgacaagcacaaggaccctggaagctgctgcggatgaacacggcgtgcttcatgagacgagtgggtggacggagatttttatctacccgggctatcagttcaaggtgatcgatgctttgattacgaatttccatctgccggagtcgacgctggtgatgttagtgtctgcgcttgcaggaagggaacatgtgctgcatgcatatgagattgcagtacaggagcgttaccggtttttcagctttggtgatgcgatgtttattaccgcaaaataggaggagttggtcccatgctggaaaagagaaaacataagcgccttaagatggaacacgcgctggaactggcgcggttaaatgcggacggcacggccgacggcggcgttgtgaatgcggatatcctgaatatctcgcgcggcggagtcggatttttgtcccgcaagagactcgaggtcggcagttattatgacaccaggatcagcctgttcagccgggagatgattgacgctgtgctggaaatcgtacatgtggaagagcaggaaaagggctattactacggcggagaatttatcggcatatcggattcggatgcggtaaagattgatatttaccaggtctttcacgacatctgaccgtgaaaatagacaaaaagacacgtctgattgtgtgcattatatacgaaatgacgataaaatggtgccacactattgacaatggtgatcattaaatttataattggagacagttaaaggatagttcacaccgcaaggtgcactaaaccggaaagctgaatacaggctatttgggcatgtatgaagttttccggttttcttttttcccaagaggagtctgttgtttgaaagaggagggagtcagatgagaatctatcgggcaaaagattattatgacatgagcagaaaggcagccaacatcatatccgcgcaggtgattatgaagccggactgtgtgctgggacttgcaaccggttcgacgccggtcggcacttatgcacagctcgtggagtggtacaaaaagggggatctggatttttcagaggtaaagacggtgaatctggatgaatataaaggactcgaccagtcgaacgaccagagttatttttacttcatggcggaacatctgtttgacaaggtcaatattgattttcagaatgtcaatatcccaaatggaatggaaacggatgcggacaaggaatgtgcgcgctatgaggcgaagataaaagcgctcggcggagtggatctgcagctgctcggaatcggtcacaacggtcacatcggattcaacgagccgaacggacagttcgaccgcacgacgcactgtgtgaatctgacacagagcacgattgaggccaacaaacggttctttgcatcggaggaggacgtgccgcggcaggcgtacacgatgggaatcaagacgatcatgcaggcgaacaagattctgatggtggcaagcggggaagacaaggcggagattgtaaaacgtgcctttttcggaccgatcacaccggaggtgcctgcatcggtactgcagcttcacaacgatgtgacactggtgggagatgaggcggcgctgtcgctgatcggctcctgtcagagttaggatatgggaatgaaatcatgaagataagtaaagtgattaataacaacgtcctgtcggcatttgatgaaaacgggcaggaagtcgttctcatgggaagaggactcgggtttaaggcgaagacaggagacgacattgacgagagccgggtacagaaagtgttctgcatcgaaaattcggcgctctcaaggcagtttcaggaaatgatctccaacatccctatggagcatatgcagatctcggcggacattatctcctacgccaagaacgagtgcggcatggagttaaaccagagtatttacgttgcgctgacggatcacatcaatttcgcgattgaacgatacaggaatgggattgcgctgtcgaacgctattctgtgggagatacggcagttctaccgcagggagtatctcgtcggagagtatgcgctccgcctttttgcggagagactggatattcatttcccggaggatgaggcgggatttattgcactgcattttgtgaatgccgaatataatacggatatacatgacacttatatgatcacggatgtgattcagaagggaatcgagattgtaaaggcagagtatcagaaagcgctggatgaaaaatccatgcactacgagcggtttgtggcgcatctgaaatttttcgcgagaagaatcttcttcagcaaggaaatgctctccgatgaggagcaggagttctccgatctgattgaactgaaatatccgagggaatatgcgtgtgccagaaaaattgccgattacatcgaagcgcagtatgactgcacggtgaccaaggaagagatcatgtacctggcaattcatatccggagaattacgacagacagcgatgaatgagaaaggagagaggctgatgtttggattatttcataaaaaagaacagaaagcgctggaactgggagcgccggtaagcgggcaggcagtaccgcttcaggaggtgagcgatcccacgttcggcggggagattctcggaaaaggcgtggcggtaagacccacggatggcaggatctacgcgccggcggatggggagattaccttgttatttgatacactgcatgcgctcagcatgacgacggataccggggcagaactgctgctccatattggactggacaccgttgcattaaagggtgcgcattttaaggcgcatgtaaagacgggggataaagtcagaaagggtgatctgctgttggaggcggatcttaaggcgatccgggaagccggatatgatgtgatcacaccgatgattgtctgcaataccgaccattttgccgaagtaaaagcggtgacgggtgcggaggtgacgccgcaggatacggttctgattctcacatcgaagtaatctgttattcaatggtattttaaccggaactttccggtataaaataaaggggcaaatcatatatggcatagggagaaggtctactgtgccagaaaaagaaggaggaagaagttatgatgaaatatcttcagaagttgggaaaagcattgatgcttccggttgcctgtctgccgatctgcggtatcttaatgggaatcggatatgcactctgcccggcaaccatgcagggtggtgacattgcaggtgcaaaggcgctgattggatttttccttgtaaaagcggggggcgctttaattgacaatatggcatggctgtttgtcatcggcgtcggcgttggtatggcagacgacaatgacggtaccgcggcacttgcggcgctggcatcctggctgatgattaccaatctgctctcgacgggcgttgttaccacattgatgccgtcaatcgcagagaatgcggataagacgctggcattcgacaagattgcaaacccgtttatcggtattcttgccggtatcatcggagcaacctgttataacaagttcaagggaacgaagcttccggactggctggcatttttcagcggcaaacgctgtgttgccatcgtatccggtgtggtatcgattgtcgtgtcagctatcctgttattcgtatggccggttgtgttcggcgcactgatcgctcttggtcaggcaattgtgggaatggatgcagtgggcgctggtatctacgcatttttgaaccgtcttttaattccaaccggtctgcatcatgcattgaacaacgtattctggtttgatacgatcggactcggtgatctggccaacttctggaagggcaagacatcggcggatgtatcatgggatctcggtatgtatatgtccgggttcttcccgtgtatgatgtttggtattccgggtgcggcacttgccatggttcacacggcaaagagcaataagaaaaagatcgcaatcggattggttggttccgcagcactttgttcattcatctgtggcgttactgagccgttcgagttcggattcatgttccttgctccggcactctatgtagtatatgcattattatacggtatttttacctttatcacggttctggtaggcttccgtgcaggcttcagtttttctgcaggtgcaaccgacctgatcttttccgcttcccttccggcggcaaagaacacctggatgattcttccgctcggaatcgcagcatttgtcgtattctatgttgtattccgttttatgatcacgaagtttgatttaaagactccgggacgtgaagatgacgatgatgatgcagagaaaggtgcaaagcttgagaataatgattacaccgaagtggcaagaatcgtgcttgaaggtgtcggtggcaaagagaatatagaaagcattgataactgcattacgagactccgtctggagatcagggattacactaaggtagatgagaaaaagatcaaatctgccggtgtggcaggtgtggttcgcccaagccagaaaacagtacaggtcattatcggtacccaggtacagtttgtggctgatgaatttaaaaaactttgtaagtaaccatattctgtaaaatagattgccccaatgaaaaacgaccgcgaaagcggtcgtttttcgatgcagacatatattcagcgctcataaatggtgtagtggtgcttttttagaagtgtgatggcggcggcgagcgattcgctgtcgtacatttccagatgcagcacgccgtcctcaaattcacggttgtggatgatgccgatattcttgatgctcaaatggttgctagcaagaatggtggcaactgtggcaattccgcccgcttcatccagaagatccatgtacagctcatatacctgctttaaggtgccgttcgcgtgaagggtcagggaatcccggtagtcttttgccgaggtaaaggcctccatcagcgctttgctgtcggaagcggcgatggcagagcgcatatgaccaagctccccacagaaagagtcaatcagtcttagaatctgttcctgattggaaagacagatattttcccacatgacgggggaggaggaggcaatgcgtgtaatgtccttaaagccgccggcggcgatggttttcatggttccttcacagtcatcgcagcttttcacaaggttgacaaggctgtaggcgatgatgtggggcagatggctgatggcggcagtggcataatcgtgctgctcgtagtcaagcaccatcggtatcgcaccgagagaagccacaagctccttaaagtcttttaatgccgcgggatcggtctgggcggtcggggtgagaatatagtaagcattttccaataaaaattccctggcattggcaagaccggtcttctcggagcctgccatcggatgtccgccgataaactgcgcctccatgccgagggcggtcacttcccggtgaatgtcggtcttgacgctgcccacatcggtaatgatgcagcggtcgcagacgtgtccctttaaaagacgcagatattccatgtttttctggacaggcgtgcacagaaaaatatagtcgcagtcatagaaatccgacagttcacaggggctggcgttgtcggtcagtccctctttgtaagcggcctctatcgtcgcggcatgaccggctgtagcgataatgaccagatctttatgtagaatacgaaggcgcttggcaatcgaaccgccgatcagtccaagcccgataaatccgattttctgaagtttcataaatgaatcccccacaagttattggtacccaattatcatagacatttccgcctggaaagtcaacacgttaatctgtgagagtacggaaagatgcggcgtgtatggcgagaacatgtccaaattgtaaatattgtgtaaataataaaaagaagtattccaaaaatgttcaaaagtaatacatattattgctaaatgtttctgatattataaatacagttagtaatattgaataaataagttgtaaaaaaagacggaatttagtaaaatatatccatacataaaacaattacagaatatggagggtttgctatgaatgtttacacaactgacagaattcgtaatgtggttttacttggtcatgggggatgtggtaagacgagtcttgtggaagcaatggcttatctggcaggcatgacatcacgtatgggaaaggttgaggacggaaataccatcagtgattatgacaaggaggagatgaagcggcatttctccatcaatacttcggttgttccgattatctgggaagataccaagatcaacatactggatacaccggggtattttgattttgtgggtgagaccgaggaggcggtaagtgcagctgacgcggcgatcatcgtggtttccggcaaggcgggtattgaggtcggcacgcgcaaggcgtgggaattatgtgagcagtataagctcccgcgcatggtttttgtgacagatatggatatcgatgaggcgagctaccgccaggtggtacaggatctgcaggaactctacggaaaaaagatcgcaccgttccatctgccgatccgtgagaacggacagttcgtcggctacgtcaacgtgctgcagcagcgggcgaagcgctggaaggagaacggcgaggttgagaagacggacgttccggattattcaaaggagaatcttggcatctgcagagaggctctgatggaggcggttgcagagacgagcgaggagttcatggaccgctattttggcggtgaggaattctctgaggatgagatccgacaggcactgcgtgtgaatgtggcggagggaagcatcgttccggtgcttatgggttccaatattttggcacgcggcatctacacgctgctggtggacattgtgaaatatctgccaagcccggaaaagcgcacctgcaccggcatcaatgccaagaccaatgaggtttacaatgcggattacgatttcgcaaaggcaaaatccgcctatatctggaaaacaatcgcagatccttttattggaaaatattcccttattaaagtcaattccggcgtgttaaagacggacgacatcttattcaatcagcataaggatgtggaggaaaaagtaggaaagctctacgtgatgcggggcaacaagccggaggaggtaaaggagctgcacgcgggcgacattggtgccctggcaaagctttccggtgcgacgacgaccgattctctctccacaaaggcgaatccgattctgtatattagaacaaccatctccacaccctatacctgcaagcgctacaaggcgaagaacaagggtgatgaggataagatctcgcaggcattgcagaagctgatgctggaggatctgacattaaaagctgtcaatgacagcgagaacggacagacgcttttatacggcatgggcgatcagcatctggaggttgcggcgagcaagctcttcgagcgctacaaagttgagatcgaattaaaacgtccgaaagtggcgttccgcgagaccatccgcaagaaagtcgatgtggagtataaatacaaaaagcagtccggcggacatggacagtacggtcacgtaaagatgacatttgaaccttccggagatctggaacagccgtatgtatttgaacagtgtgttgtcggcggcgcggtgccgaagaattacttcccggcagtcgaaaagggcgtacaggaagcggtattaaaaggacctgtggcagcgtatccggttgtcggagtgaaggcggttctctacgacggcagcttccatccggtagattcctccgagatggcattcaaggtagcggcgatgcaggcatttaaaaaaggttttatggacgcatccccgatcctgttggagccgattgcctccctcaaggtggttgtgccggataagtacaccggcgatattatgggagacttaaacaagagacgcggccgcgtgctcggcatgaatccgacggagcacggttatcaggagatcatcgcggacgttccggtgatggaactttacgggtacaacacagacctgcgttccatgacaggcggaagcggaacattttcttatgaatttgcacggtatgagcaggcaccttccgatgtacaggagaaggagatcgaggcaagggcatccaaggtagaacgtgcggaagagtaacagcagtatgtaaaagcagcagaaaagagtaataggcagaaaagaaaggaggatgagcagagatgagaaaagaacttcttgcactggtatcgatgtttgtcctccttttgaatgatccgatggtggcacaggcttacatgatggttccgacggatggcacaggatgggagcagggcgggacggcttcgattgatccgttcctcggcgtgaacgatgacgctgtgcatctggtgtatgagttaaacggcggtgtgaaccacaatgccaacctggatgtgatcgcagtggaagaacttccctttacgcttgagattcctgtccgggacgggtataattttgccggctggtatacggacagctcctacgatcacaagatcacggagatcacggaagaaaatgcagcgaatatggttctgtttgcaaaatggaccagaccgatcgacaaccgctataacgtcgagatgtattcctatcagaccgcgagcgtgttaagccgcaatcaaaaagaattaaaagagtgcaattatgcgtttctggatgatctggatattccgggaatgccgtccaccagagagaaagactatctcgacaatctgatcagcagcgagggacagtgtctgcagggactctgcttcacaccggattacattcttatgacggcgtatgcggatggatccgacacgaaaggctccttaatgatctttgagcgtgagaccggaacctatctggcgacgcttggcatgaaggagaagagccacctcggcggaattgcctttgacggggagaatgtatggatctgccattccaattcaaagacgctggagcggattccatatgaatatattgagagaatcggagccgatgcacccggatactgtgtggacgcatctgcactttccgacgaatacaagctcgacaatattccgtcctgcatcacctgctacggcgggcgaatctgggtggcaacccacaccaaattctttgattccgagatgctttcctacagctacgatgaggaaaatgatacgcttacctcactcagcagctacaatattccgaacaaagtgcagggaattgcctttgacaaaggcggtcaagtatatctgagcacatcttttggacgcaacagttcctcctacctgaaagtatacgcatcgcttctgacgctgacgaagcatcccaatgagccgtcggcaaaggtagagatgccgccatgctcggaggagatcgcaattgcggatgataatgtgtatgtgttatttgaatctgcaagcctgcgttattttgagggaaccgacggcaagggcaacagcagctcgccgattgacaaggtgctggaagtgacggtggcgtcgatctggtaaaaaatagaagaacagcacagaaggagcggttttaagagccgctccttctgtttttcattaggttcatgattttgtcagctttggcagattcttctgcggacatgttctgctttaggatctggaataagagatccgtctccggttcactgaactggatgttatttgattttgcggaattcatggcagagagcagaaacggcatcatctccttgatgtcggtcggctttttggcggtggcaaagttcatgagaaactgtagcttctccggagacatatcggcgagaagcggattgttgttcaaaaaatcgtagggcataggaattcctttctgtttaactgaagatggtttcgtaggtctcaagcatggagaacatattcgcaagcatgtcgatggtttcctgctctttgctggtgcagaaagcgcgcagatcgtttaacatggcaaccatattattgctgccctcatcgacggagcacatggacatcaccttgtcatcctgcgagaacacctggacggtgttttgcagctccatatattttatcaatatggcaaattgctttttttgtgtatctttcatgtaggggagcatggtttttaacatctgcagttcccgtgtctgtgtcatataatcaaacggtgtaaaagtggatgtttcgttatgatccataagaaccctttttcttttagtttatgagcagagaagagactttatgaccggtaacgcatatcatataatgtgggcaaaggcaaaaggaagcatggaataaaagaggcaggacttttgccggagcgcaatcatatacgcgtctgtggaatggagattggtatgcttataatagaaggtaacagtgtatacgagattgatgaggaatgtgtgcgaaaaagaaaagtccctgaaaaatgccagacggcacagaaattgcagatgcagagaaaacgggatgcggagagcggtcttgagaaaaagagcgaacgctagaataataaaaatgaggagcggcaaatgccgctcccttttagaatccgtgtgcgtttttattagcagcagccgaatccgttgccgttgccgtttccgcatccgccgcagcagaagagaagcaggataatccaaaggcagctgtcatttccacagccattgccggaattaagaccgcagccgttgccaccgcagcagcacagcaataagatgatccagagaatggaaccgcatccgccctcgttacaggaacatccaccaccacagtttgtcgcagctaaatcactcatattaaatcctccaaatttttcttacactgtatcttatggcatccggaaagatttgttacaaatttttctaaaacaattgttatgcgttctctaatttgctatgatgaacgtagcaaaacagagccagatggcgggagggatgaacatgggatttgttgtaattgcggaaccggatgaagtaaatgcggcgcgcattaagacgatattagacagtctggacaaggatttttcctatgcacttgtcggttcagcggaagcagcgatacagcttgtggagcagaataccaccgatgtgtttatcgcggatatgcagatgccggtgattaagggaacagaactgttttcaatgattgagatgatgtctccggagacaatacggatcgtgatgactgacggcgcacggattgcagatactgtggcatttatgaatgaatgccgtacctttaagattatcatcaagccgtgccgtgtggcagatgacctcatggctccgatccgtgcagcctttcggtataaggaacagctggagcgggctgccggacaggagcaggaacaggagactgcgtacagcatgacggagcaggcgtatctggagcaccgcaggatgtggctgatgcgggcaagcaacaataagagagcgcaggacgtgctggcggaactgatgaaggtgaacctttctttttcagatatggaagcagaacgaaaggaacgcctcggacgctggtatgtctggattgtatccgaatacatcaactgtgtttcgtgcgggactggcgagtttaagaccgcagccgaggggcttgcggcattcggcaataaaccggaacagcaggaatattttgaattgaggtgcactgccgatgaggtggtcgacccggaacggatgaacgaggtcacttatattctgcggattattaccggactgtgtaaggatatcttaaacggctatcggatcatggcaatcctggagccgatggaaaaggtctatgtgcttcgtgtgcgcatacagatgtataaagattcattcagaattaaaaatacaacaatgcgggagggattgtcacgcgcaacggaacttgcgatcgacgcgctcggatacaaatctgtcgtcatgaacaaggagcaggagacgatttttaatctggcattacggcgctgaatgtcataatgtctgccattactataacaaagcattatatctgctataactttttattcattgacaaatagaacaagaaatgtatagtataagaagacggtataattgtatacaattatgcaagcggttatttatgcaatgatcaagaaagattatacgacggagagaagccgtgaaggaaccgccgcattggatgatggcaaaaggagtgcagctatgagagaagtcgtaatgaataagaaaacgaacctgctacagttggaagagcatttttatcagctcgtggatgtggaagagccgaacgtattccacaatctgttcccgtacagtgagataccgaagatcgcattcaatgatcgtattgtcccgcacaacatgccggagaatatctggattaccgacacgacgtttcgggacggtcagcagtcgagagctccttatacaacggagcagattgtaacgatctatgactatctgcataagctgggcggtccgaaaggactggtccgtcagagtgaatttttcctatatagcaagaaggacagggatgcggtctacaagtgcctggaaagaggatacaagttcccggaggttacgagctggatccgtgcaagcaagcaggatttccagctggtgaaggacatcggactcagagagaccggtattctggtaagctgctcggattatcatattttttataagatgaagatgaccagacgtgaggtcatgaatctgtacctgagcgtgatccgcgagtgcctggagacgggaatcagtccgcgctgccatctggaggacattacgaggtcggatatttacgggtttgtcattccgttctgtgtggaactgatgaagctgatggatgagtacaagatcccgatcaagatccgcgcgtgcgataccatgggatacggcgtgaatttcccgggtgccgtgatcccacggagcgtgccaggtattatttacggactgaccacccatgccggcgttccgtcggagttgattgagtggcatggccacaatgatttttacaaggcggtcaataactccacaaccgcatggctttacggcgcaagcggcgttaactgctccctgttcggtatcggagagcgcaccggaaatacaccgcttgaggcgatggtctttgagtatgcgcagttaaagggaacacttgacggtatggatacaacggtcattacagaactggcagaatactttgaaaaagaactcggctatgtacagccgagccgcacaccgtttgtcggaagcaactttaatgtgacgagagcgggaattcatgcagatggactgctcaagaacgaggagatttacaacatttttgatacggggaaattcttaaacagaccgcctcttgtatcggtgtccaacacatcgggtcttgccggaattgcacactggatcaattcgtactatcatctgccgaaggagaaatgggtcgataagaattcggatctggttaagaaaataaaagtctgggtggatgcacagtatgaggacggacgtgtgacggtacttacggattccgaacttgtggaagagatcggaaagtgctgcaaagagctgaacatcacgatatagcatgaggtaaatagatgagtgaggataattattcgctgagttcgcgcgtgtttcacacaatacgtgaaaatatactgtccgggaaatatgcgacggacgaggaattaaaagaaaaatccatcggagaggaactgggtgtcagccggactccggtcagggaggcactgcgccagctggaactggagggtcttgtgaccatcattccgaacaagggagcatatgtcgtcggaatctcccagaaggatatccgcgatatttatgagatccgctccaggctggagggactctgcgcgaggtgggcgtgcgataacatcacaaaggatcagctggatgagctggaggagaacatttatctgtccgatttccactcgtccaagggaaattccgagcaggtggtggagcttgacaacaagttccatgaaattttatacgatgcgtcaggcagcaaggagctgcgccacatcctgagggattttcaccactatgtgcagcgcgtgcgcaaggtgacgctcgccgtgcaggagagagcggtcaattcaaatgaggagcaccgcaagattgtggaggcgctaaagcagcatgacggggccagggcggaagaactggcggacgcacatatgcgcaacaccattaacaatatggatcattacggctgggacaatctgctcaagcagtaagagcggaagatgccatgtcagatagaacagaatcacagcacagaaaggaagcagccatggaaaaaatcaaaatgacaacgccacttgtagagatggacggagatgagatgacacggattctctggaaaatgatcaaagacgaactgttgtatccgtttatcgatcttaagacggagtattatgatctcggactggaacaccgcaatgagacggacgatcaggttaccgtagattctgcaaatgcaacgaaaaagtacggggttgctgtaaaatgtgcgacgatcacgccgaatgccgcccgtatgacggagtatcatctcaaggagatgtggaagagcccgaacggaacaatccgcgccatgctggacggaacggtgttccgtgcaccgattattgtcaaggggatcgagccgtgcgtgaagaactggaaaaagccgatcacgatcgcgagacatgcatacggcgacgtctataaggcgagcgagatgaagattccgggaccgggcaaatgcgaactggtctacacggcggaggacggaaccgagacaagagagctgatccacaattttaccggtgcgggcgtggtgcagggacagcacaacctctgcaattccatcgagagctttgcgagaagctgctttaactatgcgcttgacacaaagcaggatctgtggtttgcaaccaaggataccatctccaaaaaatacgaccacaccttcaaggatattttccaggagatttatgacagcgagtatgcgcagaagttcaaagatgccggaatcacatatttctacacactgattgatgacgcggtggcgcgtgtgatgaagtcggagggcggctatatctgggcgtgcaagaactatgacggcgatgtgatgagcgatatggtatccagcgcgttcggttcgctggcaatgatgacctccgtgcttgtcacaccggacggaaagtacgagtacgaggcggcgcacggaaccgtacagcgccattactataagcatctgaagggggaggagacctccacgaactccgtcgcaaccatttttgcatggacgggcgcactcagaaagcgcggagaactggacggcagtcacgagctggaagagtttgccgacaagctggaaaaagcttgtgttaagaccatcgaggatggtaaaatgacaaaagaccttgcgctgatcacaaccatttctaatccggttgtattaaacagtgaagattttatcaaggcaattcgcagcacgttagaaggaatgttattgttatgattttatcctgtcagaatatttccaagtcattcgggacagacgaaattctcaaaaatgtaagttttcatatcgaagcaaatgaaaaagcagcgattgtcggcatcaatggtgccggcaagtctacgctacttaaaattattatgcagaaagagacgccggataccggtgaggtgatccttgcaaaagacgccaccatcggctatctggcgcagtatcaggatgtgtccgggcaccggaccatctacgaggaagtccttgacgcaaagaagaacatcatcgagatggaggagcgtctccgcgggatggaggcgcagatgaatgcgctcacagggcaggagcttgaagcgcttctggacgggtatcaccggttgagccacgagtttgaactgctgggcggctatacctaccgcagtgaagtgacgggaatcttaaagggacttggctttgtggagagtgaatttgaccggcagatgagcgaactttccggcggacagaagacgcgcgtgtcactgggcaagctccttgtgacaaagccggatgtcctgcttttagacgagccgaccaaccatctggatatggaatcgatccagtggctggagggatttttgatgaactataagggagcggtcgtgatcgtgtcgcatgaccgctattttctggaccgcgtcgtcaccaaagtggtggagattttccagcatcaggggtatgtctaccagggaaattacacggaatttgcgaagaaaaaggcgaagatccgggaagatctgttaaagcagtattacaaccagcagcgggagattaagcaccaggaagaggtcatcacaaagctcaagtcttttaaccgcgagaaatcgattaagcgggcggagagccgtgaaaagatgctggataagatcgagcgtctcgaaaagccgacggatgagaacacggacatccatattgtgctcgagccggatgtgacaagcggtaatgatgttcttacggtggagcatttaaggaaagcgttcggaacacatacgctgtttgacgatctctcttttgagattaagcgtggggagcgcgtggcgctgatcggcaataacggaaccggcaagacgacgattcttaagatcatcaacgaactgcttctggcggacggcggaaccatcgtgctcgggtcgaatgtgcacatcgggtactacgatcaggaacatcagctgctccatatggagaaaacgatctttgaggagattgcggatgactatccgcagttaaaccacacgaagatccgcaatgtcctggcggcgtttttatttacgaacgatgatgtattcaagcggattgcagacttaagcggtggggagcgcgggcgcgtctcccttgccaaactgatgctttccgatgcgaattttctgattctggatgagccgaccaaccatctggacatcacatccaaagagattttggagtcggcgttaaaccagtacaccggaaccgtctttttcgtgtcgcacgaccgttattttatcaatcagaccgcaacccggattctggatttgacgggagggacgattgtcaactatatcgggaattacgattactatctggaaaaacatgacgagctgacccggatctatgtggaggcggagccgaaggcgcaggcggcgcagatgacggaacagaccgtggcgcaggacggaagtggaacagacaagaaagcggactggcagacgcagaaagccgagcaggcgcgcatccgcaagcttgagaatacgctaaagaaggcggaagagcgcattgccgagctggaggatctgatcgccggcattgatgaggagtgcgcagatcctgccaatgcaaccaattccgcgaagctcggcgagctgaccggcagacagaatgaataccggagcgagctggaaaaatgctacgaggaatgggagcaggtatcgatggagcttgagtcgtgagggatgccgtctggttgttaaatttttgacacattgacagatatctggtttatcactataataaaagagatgttttgatagaaaggtgggcatcaccatgcaggaaaaagaaatatcacaggctgtcattcgtcgaatgccgcggtattacagatatctgggagaattgctggacgccggggtagaacgtatttcttcaaatgatctgagcctcaggatgaatgtcaccgcatcccagattcgtcaggatctcaataattttgggggatttggccagcagggatatggatataacgtaaaatacctatatgaggaaatcggcaagattctaggactgaaccagcagcacaatattatcgtgatcggtgccggaaatctcgggcaggcactcgccaattacgtgaagtttgaaaagcttggatttatgatcatcggactgttcgatgtcaatccggcgttggacggtgtgactgtgcgcgggatcaagatccgtatgctggatgagctggaagatttctgtagagagaacaaagtagacattgcagcgcttaccatgccgaaggaaaaagcggacgccattgccaaccgtctggtcggtcttggcattcatgcgatctggaattttgcacatgtggatctggaattgatcaataaggacgttgttgtggaaaatgtccatctctcggacagcctgatgcagttatcctacaatattgtgaagaatcagcgcgccaaagagaacagccgtcagacagattaaaagaggtcctgcatagcaggatctcttttttactctatagggaactttgttccagtgttttactgaaataaaatgccgggtgtgatgccggcaggcgggagggaaaagatgcgatatatcgtaaacagccgggagatgaatctttatgacagccggacaatcgaggaatttcatatgccgcaggcagtgttgatggagcgggcggcgttttcctttgtggagacactgcgccgggaaaaacggaatacgtcaagaacactcgtcgtctgcggcagcggcaacaacggcggagacggctatgcgatcgccagaatactcatgcaggcgggaaacaccgtcgatgtattggaagcgccgcacacaggaaaagcgtccgtcggcaatcagctccagaagaagatctttcttgcgtacggcggtaagatcctcacggaatttccggaggggaagtcctacacgctcgtgatcgacgcggtattcggcgtgggattatcgcgcagtgtggagggagaatacgcatcgttaatcgaccggatgaatgccatggaaggggcgaaggcggcggttgacattgcttccggcatttcggcggacaatggaaatgtgctgggaaccgctttccgggcagatctgacggtcacattcgcgtttgaaaaggtgggatgcctgctgtggccgggcaatcagtacgccgggaaagtcgttgtggcggatatcgggattacgccggatgcattcggggagcgcaaaccggcggtggcagcgttagaagacgcggatctgtcccttcttgccgcaagggagagccactccaacaagggaacgttcggcagacttctcgtgattgccggaagccagggaatgtccggagcggcatatctttgcgcgaaagccgcatatgcaagcggctgcgggctggtgcgcatttttacaccggaggaaaaccgcgccattttacagacgcagcttccggaggcggtaatcacggcatattcctccaaaaaggcggaggcgccgcagcttttggaggcaatgagctgggcggacacgatcgtgtgcggaccggggatcggcacgccggatacggctgcggggatggttcgcacagtgatcaagaatgcggcggttccggtgcttttggatgcggacgcgctgaatgtgattgcaaaagatacaaacctgctgcttctgccgcacacggaactcgtggtgacgccgcaccttggagagatgagccggctgacgggggattcggtggcgtatctgcagaatcatctgattgaggcggcggatgaattcgcaagacagtataatgtgatctgcgtcttgaaggacgaacacacggctaccgcgattccgtacagccagacatggctgaatgtatccggcaatgccgggcttgcaacggcgggaagcggggatgtcttaagcggtatcatcggcggactgatggcgcagggaatccgtgtggagcaggcggcgccgctcggcgtctacctgcacggaaaggcgggcgaagcggcaggtgcgcggcgctccatgcgcggcatgacggcatcggacattcatgacggaatgtgcgagatcctggccggactggaacagacgcagtcacagccgggaaaagatggcatatcatagtgttgggaaaataaaaacaaaatggaatacacccgtgaaaaatggcaatactatccgtaaaagatccagagagaaatggagtggaaagtatggtaattcgacgtggggatatcttttatgcagacttgcgaccggtggtcggctcggaacagggcggtgtgcggccggtgctcatcatacagaacgatgttggaaacagacacagtccgacggtcatctgcgcggcaatcacatcgcagatgaataaagcaaagcttccaacacatgtggagcttgacagccagaaatatgcgctggtcaaggattccgtggtgctgttggaacaactgcggacgatcgataagacgagactgaaagataaagtgtgccatctggatcaccagatccttgtgaaaatagacaaggcgctggagatcagtctggaactctatacataacttgactattatgcgcgaaaatgttatgatttctgatgttttagtgtgtaataccggagacacgaaagaaaggatactatatggatgatggttgcagccccactgtgggcatcctcatttttgcaggatttgtcatattagattttgtggtttttggctttatcgccgccatgcagaatttgaatgaggctgccatagaacgtctggcgggagaggaagaccgcggtgcgagacttctgcggcgctatacggataagaatgaacgatatacgcatgtctgcgaactggtggttttaatcgtgcatatgctgctcggttttctggaggtaccgctctggcgcgcgtattttctgccggaagatgtgggaagcgtcatgtcggtacttgtggatgtcctcatttttgtgatcctgattctcattgtgctggtgtttggaatctacacgccgcagaaagtggcgtccagaaagccggaagcctgggcactgcgtctggcgggaccggtacatgtggtggagcttcttttttacccgatcatattcctgacggacggtttagccaaccttctggcgcgcgtgttcggcgttgatccgttaagcgatacggatgatgtgacggaggaagagattatctccatggtaaacgagggtcacgagcagggtgtgctccttgcaagcgaggcggagatgattcataacatctttgagtttggcgacaaggaagccaaggatatcatgacgcaccgcaagaatatctgtgcgctcgacggaaccagaacgtttcgacaggccctggagttcatcaaggagaacaactattccagattcccggtgtttctggacgacatcgataacattatcggtgtcctacatatcaaggaggctctggaactgagcctggatgcggcggtttatgacacgccggtctctaagatcaagggtctgatccgcgaggtggacttcatccccgagacgcgcaacatcaattccctgtttgccatgatgcaggcagccaaaagtcatctggtgatcgtggtggatgagtacggacagacggcaggcattgttgcgatggaagacattctggaagagattgttggaaacatcgaggacgagcacgacgaggagacgaacatggtcgaactgcagccggatggaagctatctgatgagcggtatggctccgtttgacgaggttgtggaagtgctgggaattccgctggatgaagaggacgatttcgagacgttaaacggttttttgatctcactgatcgataagattcccagcgacgacgaggtgttttcaacaaccgcatacgggtatctgtttgagatcctttctgtagagaacaagatgatccagaaggtacacgtgatcaaacttccggaggagaaggcttcggaagtcgaactggcagacgggacttgccagaatgaagaataaatgttaaaataataaaccggatttcaacagaaaagaggaaaaaacatgtcaggacattcaaaatttgccaacattaagcacaagaaagaaaaaaatgatgcggcaaagggaaagatttttaccattatcggaagagagattgctgttgcagtaaaagagggcggtcctgaccctgccaacaacttcaagctggcacaggtcatcgccaaggcaagatccaacaatatgccgaacgatacgatcgagcgcggtatcaagaaggctgctggagacggcaactcggtcaattacgaattctgtacttatgaaggctacggtccgagcggaaccgccatcatcgtaaagtgcctgacggacaataagaaccgtacggctgcgaatgtgcgcaacgcgtttacaaagggacacggcagtatcggtacacagggctgtgtatcttatatgtttgatgagaagggacagattattgtcgcaaaggaagattacgagggagatgcggatgagctgatgatgcaggctcttgacgcaggagctgaggatttttccgaggaggaagacagctacgagatccttacagcgccggacgattttgaggatgtccgcagagcgttggaggatgcaggtattccgatggcagaagcttctgtgaccatgcttccgcagaactatgtggagctaacagcggaggaggatctgaccaacatcaaccgtattctggatcttctggatgcagatgatgatgtgcaggaagtatttcacaactgggatgaataataaatttacaaagagagggcagaccataacagatggtttgtcctttttttgtaaaacgctggaattgtagggtgaaatggtatatcataatattgtatatgctttctgcgaaaaacaggatgtttccgatacaaggaggtttttatgaaaaaaatactttttgcagcttctgagtgcgttccgtttatcaagaccgggggacttgcggacgtctgcggcgcgcttcccaaggaatttgacaaggaagagtgggatgtgcgggtggttattccgaattatagctgtattccggaaaaataccgcagccagtttgagtatgtgacgcatttttatatgagcgccgggacttatatccaggacaagtacgtcggggttcttcagtatgtgcttgatggcatcacctactattttatcgataatcaggaatactttaactgcatcgtgccttatggggacatccggtttgacattgagaagttctgtttttttgacaaggcggtactctccattttaaaacagatcaatttccggccggatctgattcactgtcacgactgggagacgggactgattccggtttatctgaaaaatgagttccaggcggactccttttactggggcatcaagtcggtcatcacgatccacaacttaaagttccagggaatctgggacatgaagacaatgcagggactgaccggtttctcggcggatctgtttacgccggataagctggagttccagaaggacgccaacatgttaaagggtggactggtgtatgcggattacatcacgaccgtcagcgattcctatgcgaatgagattcagacggagtattacggggaagggttaaacggtctgctctcggcaagacattacgacatgcagggaattgtaaacggaatcgactatacggtttacaatccgaagacggatccaaagatctatgtcaattacgacgccgcagatttccgcaagaaaaagccgtccaataagatgaagctgcaggaggaactgggacttgccgtcgacaagaaaaaatacatgatcggcctgatctcaagactgacggaccagaagggactcgatctcatcaattacgcgatcgaccgcattgtggacgactatacgcagttcgtggtcatcggaaccggtgatccgcagtacgagaatatgttccgccactatgcatggaagtacggcgaccgtgtctcggcgaatatctgctactcggacgaacttgcccacaagctgtacgcggctgcggacgcgttcttaatgccgtcgcggtttgaaccgtgtggactgacgcagttaatctctttccgttacggcacggtgccgatcgtgcgtgagacgggcggactccgggataccgtaaagccgtacaatgagtacgagaacaccggagacggattctcgtttgcaaactataacggagacgagatgttaggcgtgatcaactactccaaacatatctattttgaccgcaagaagcagtggaaccagatgattgaccgcggaatggcaaacgactattcctggaacaattccaggggacgctatgagggattgtaccgctatcttctgggagaagtgtagcgtgaactgacataatatgacgctggatgatacatactaagcagggtgcaattttgcaccctgcatttttatgcaattagtaaaaagagaagaccgaaggagaaggagaaactatgtcagaaaaacaggaacagaaaaatgaggatatccgggaattcggacaggttgcgttaaataacaaccgggagaacaaccggatctcacttttaacgattataggagagattgagggacacgattgtctgccggcgacgactaagacaaccaagtacgaacacgtgcttccgaagctggcggagatggaggacaaccgggatacggaaggaatcctgctgctcttaaatacagtcggcggcgacgttgagagcggactcgccattgcagagatgattgcgtcgatcagcaaaccgacggtatcgctcgtgctcggaggaagccattcgatcggcgtgccgctcgctgtctccacggattactcgtttattgtcccgtcgggcaccatggtgattcatcccgtgcgcatgagcggaactgtcataggagccaagccgacctacgattattttaaacagatgcagaaccggattttaacctttatcgcgtcgcattcaaaggcgggggaagagcgtctggaggaactgatgatgaacacgggaatgctgacaaaagaccttggaaccattttagtcggggaggaagcggttcgggaagggctgatcgatgccgtgggcggaatcgatgccgcgtttttaaaactgcatgcgatgattgatgccgcaaagggaaaaaattattaagaaaccttttaatgacaaccgccctcaaatatgttaaaattggtcatgtatgtataagtttgacagatttttacgaatcggataaggaggctgccatgtcattattacaggcgatcttgatgggcattatacagggactgaccgagtttttgccggtgagcagttccgggcatctggcactttttaaaatactgtttgatgtcaataccgacacgggaattttatatgatgtactgcttcacgtcggtacattgattgcaatctccctggtatactaccgggacatcttaaaactggtggtagatggatgctgcatcatccgcgacgccggatacaatgtgattgtcttcttccggaataagaccggcaaagagcagatggcgtatcgacgcgtgatcaacagcagctaccgcaaatttgccatgctgattatcgtatcgacaataccgactggaattatcggctatttctgcaaggatgtcgtggagatggcttccgagattctgattgttccaggcatctgccttatcgcaacggcagtgttgcttttgatcgcggatcactgcaaggacggcgacaaacttccgaaaaacgtcacctacacggatgcgttttctgtcggaatcgcacagggaatcgcaacgcttccgggactttcacgctccggtacgacgattaccgcctgcctgcttgcgggttatcagcgcaattttgccgtgaaatactcgtttttgatgtcgataccggcgattcttggcgcgcttgttctcgaattaaaggatgccacagacctggcggtgtcgggaacggaggttgtctactatgtgatcggtatggcggtcgcggcggttgtgggatatgtctgcattaagacgatgcttgtcatcgtccgcaaaaagaagttcactgtttttgccatctactgtctgctcgttggcgcattgtccatcggcgggtatttttatctggcataacggttttggaggttagtaagttttggcaacagggaataaaaagagtacatctgggaaacgaaaggcacagacaagccggaagggaagtacaggacggaagaaaaagacggctgcacagcagcaggaggattttaccagggaggtcattctctggatcattgtagcggtatctattttattatttatcagtaatttcggaatcgggggaaccatcggcaatgcagtgagcaggttcttttttggcgtcatgggactgatcgcgtatgtgttcccggtgcttcttcttgtcggtactttttttgccgtgtcgaacaggggcaaccgggtggcaaccgtaaagcttgtggcgatgattctgtttgatctgttcttatgtatgctgatcgaactgctgaccaaagggtctgcggttgacggtgccgctgcggcatacagctacagttttgagcaccggacgggaggcggcttcatcggcggacttctggcatggattttctgcccgaatttcggtctggctggttcttatgtgatcgatgcgatcatgttaatcatatcgctggtgttaattacagagcgctctgcgcttcgcggaatgcaaaaaggcgggaaaaaggtctacgaatccgcgcgcagcggaaatgaacgccataaggaacgcgtgagaatccagcgggaagagcgggagcagcgcagagaggaacaggcattaaggcggatggatcgcaaggtggaaggggttgccattgacacccgggtgctgccgcggcagaatgtcattgaacattccgatgagatcagtgaactgaatgcggaggattatctggagatgccggaggtacgggaagaaaagattgtgcctctcacgtcggacggcggatatccgcctgcagagaatctgacgccgtcggcgttctcagacgaagcgcttgcggctgtgacaccggaggcttcacagaacatatctgcatggactccggaaacggagactgcacagggagcatcctggaatactgcgccggcggaagcatcgtgggatgtggcaacagagccggaagatccatggagcactacagcctcgcaggaacagaaagatccgtggagcagcgcagccgaaccggaagatccgtggagcactgcatctgcgcaggaacagaaagaatcatggggcagtgcggccggaccagaaaacgcatgggaggcggctgcgccgaaagtacagctgaaagagccgcaggaagcatcggcagccgtatcgcccgcagagacaaaggctgtgtccggcatcggggaaaatgccggacataccacatctgcacctgcggcatccggtgaaagtgtgtcggcggagcagatgcctccggagcgtccgtatgtgttccctccggcagatcttctgacaaaggcggcaaacaaagccggggattccagacagcatctgcaggagacggcgatgaagctgcagcagaccttaaagaatttcggcgtgaatgtcacgattaccaacatcagctgcggtcctgccgtgacgcgctatgaactgcagccggagatgggagtaaaggtcagcaagattgtcaatctggccgacgacatcaagctgaatctggcagcggcggatattcgtatcgaggcaccgatccccggaaaggcggcgatcggtattgaggttccgaacaaagaaaacgtcatggtttcttttagagaactggtagagtcggaagaatttaaaaagcatccgtcaaagatttctttcggcgtcggaaaggacatcggcggaaaggtgacggtggcggacattgccaagatgccgcatcttctgattgccggtgcgacgggttccggtaagtccgtatgtatcaacacgattatcatgagcatcctctacaaggcgaaccccaaagaggtcaagctgattatgattgatccgaaggttgtggaactgagtgtctataacggcatcccgcacctgatgataccggtggtcaccgatccgaaaaaagcggcgggtgcactgcactgggcggtggatgagatgacagaccgttatcagaagttcgccaatgcctcggtgagagacttaaagggctacaatgcgaagatcgaatccctgccgacgatcgagggcgatccgaagccggaaaagctgccgcagattgtgattatcgtggacgagctggcggatcttatgatggtatcgccgggcgaagtcgaggaatccatctgccgtctggcacagctcgcaagagcgtgcggcattcatttgatcattgcgacacagcgtccgtcggtcaatgtcattaccggtctgatcaaggcgaatatgccgagccgtatcgcctttgccgtgacttcgggcgtggattcgagaaccattctggatatgaacggcgccgagaagctcctcggcaagggagacatgctgttcagcccgcagggaattccaaagccggtgcgtgtgcagggcgcatttgtatcggatgaggaagtatctgccgttgtagggtttatcaaggaacagaatggtcaggtgacctacagtgcggagatggaggagaagctgagcaacatggaatccgccaacaccaccgtagcgatcgattccagcgcggatgcaggggacggcagggacgtttattttgcagatgcggcgcgccttctcatggagaaggaaaaaggttccatcggcatgcttcagcggtattttaaaatcggttttaaccgtgcagcccgcattatggatcaactggaggaagcgggtatcgtaggtcctgaggaaggcacaaagccgcggcgggttttaatgtcgcccgagcagtttgagcagtacgaagaggaatatctgtaacaggattcatataaaacatacaaagccgctctggcggcggaatggaggagacattatgaaaagtgatattgaaattgcacaggaagcccagatggtacatattcgcgaggtggctgcaaagcttgacatcccggaggatgatctggaattgtacggaaagtacaaggcaaagctttcggacgagctgatccgtcgggtttccgacagaaaagacgggaaactgattcttgtgaccgcaatcaatccaacgccggcgggagagggaaagaccaccacgagcgtcggcctcggcgaggcattcggcagacttgggaaaagggcggtcatcgcgttaagagagccgtcccttggaccgtgttttggaatcaagggaggtgcagccggcggcggatacgcgcaggttgtgccgatggaggatctgaatctgcactttaccggtgatttccatgcaattacctccgccaacaatctcctggcggctcttctggacaaccatatccagcagggcaatgagcttggaattgatccgcggcagatcgtctggaaacgctgcatggatatgaacgaccgtgtcctccgtaacattgtcgtcggtctgggaagcaagatggacggaatggtaagagaagatcactttgtcatcacggttgcgtcggagattatggctattctttgtctggctgacgatatgcatgacttaaagcgccggctcggacggattatcgtcgcatatacgtttgacggaaagccggtgaccgcggacgatctgaaagcgaccggcgcgatggcggcactgttaaaggacgcgctaaagccgaacctgatccagacgttagagcacacgcctgccattgttcacggaggtccgttcgccaatattgcgcacggatgcaacagtgtccgtgctacaaagacagccttaaagctcgcggattatgtgattacggaggccggctttggcgcagatctcggcgctgaaaaattcttcgatatcaagtgccggaaagcaggactggcaccggatgccgttgtgctggttgcaactgtgcgtgcactcaaatacaacggcggcgtggcgaaagcggatcttggcacagagaatctggacgcgttgaagaaaggaattgtcaacctggagaagcatattgagaacctgcagaagttcggtgtgccggttgtggttaccttgaactcctttgtcacagacacaaaagcggagacggattacgtggagcagttctgcagagaacgcggatgtgagtttgcactttccgaggtctgggaaaagggcggtgaaggcggcattgagcttgccaacaaggtgctgcttacactggagcagaaggaaagccatttcaagccattatatccggatgatatgagccttgaggataagatcgcaactgttgcgagagagatttacggagccgacggagtgacctattccgcagctgccaaaaaggaactgaagagaattaccgatatgggaatgtcatccttcccggtctgcatggcaaagacacagtattctctttcggatgaccagacgaagcttggaagaccgaacggttttaccatcaatgtgcgcgaggtttacgtatcggcaggagccggctttgtcgttgcagttaccggttcgatcatgacgatgccgggactttccaagaacccggcggcgtacggtattgatgtcaatgatgacggagtcattaccggattattctaagagacagaatggaggatacgtatgacacagatcattgacggaaaaaagatttcacaggagatcaaggacgaactgcgcgagcaggttgcggaacagaaaaagcttggaaaagaagcagcgcttgcagtgatccaggtaggaaccgatccggcttccagcgtgtatgtcaataacaaaaagaaagcctgcgcctatatcggcatcggttccctgtcctatgaactgccggaggagacgacggaggaagaacttcttgcgcttgtggagaagctgaatggtgatgcttcggtaaacggaattctggtgcagcttccgcttccggcacagattgacgcagacaaagtgattcgtgcgatcgcacccgaaaaggatgtggacggattccacccggaaaacgttggaaagcttgtgatcggggagccgggatttgtctcctgcacaccggcgggaatcatccagctcttaaagcgctccggaattaagatggaaggaaaacattgtgtgataatcggcagaagcaatatcgtggggaagccgatggcacttttaatgctacgcgagaatgccacggtcaccattgcacattccaagacacagaatctgccggaactttgcaaaacggcggatatcctgatcgttgcaatcggaaagccgcagtttatcacggcagattacatcaaagaaggggcggttgtcatcgatgtgggaattcaccgcgatgagaacaacaagctgtgcggggatgtcagatatgatgaggttgcgccgcatacgtcggcgatcacaccggttccgggcggagtagggcctatgaccattgcaatgctgatgcataattgtgtggagtccatgttgcagtaacagatgtagaatccatatggatgaaagagtgagaggaatcgtttcatatgaaatgtgcaaagtgtggggcagagatcaaagagggatgtatctactgctccgtgtgtggaaatgcggtacagattgtgccggattacagtgtgttggaggatgactatctgcgttctcttctaaaagaggaggaatctgccgggaaggaaccggcgccggcacaggcaaagcagcaaaagcccaaacagccgcagaggaagaaaaatcgccggctgccatttctcatcgggggaattctgctggtgcttctcgttctggcgggaattctgattaaggctgcaattgatcaccggaatgccaattcttacgactatcagatggaacaggcggccatggcggctgatgcgcagaatgacggggaggcacttgactattacgagcgtgcgctgtatctgtatccaaacgatattaccgcgcgtgagaagatgattgaaatctatgaaaaacagaaaaataccgatgcggcaatggtgctcctgattgagatcataaagcttgatcctgccaatgaggacgcatacagagatctgatcgctatctatgatgcgagggaagattacgacagcattctggatctggaagcggaggtcgatgccgaggatcttaagaataaggataagattctggatttgtttgcggattacatgacatctgcaccgctgattacggatcctgagggagatgtgccgtccggaaagtatgatgaggcgctcgaggtagagattgcgtcgacagacggggatgccatctactatacgatcaatggagatgagaacgaactggatgccaagaccggaacgaggtattttgtcggaaacccgctcgtctttgatgagagtggcaaatataccatcgcggcggtctgccggaacgataagggaatctacagttccgtgacgtatgccgattttgagatcgaacttgcaccaccggattttgcagaggtgtcgccggacggaggccgtttttatgagccgacactcgtgacgctgaccgcagaggatggatgcagcatttactatacctgggacggaaccgatcctaccacggcgtctgcgcgctacacggagccgtttgaggtgccggagggcaacaatgtcctgtccgtacttgtggtggacaaaaagacgggattggacagcggtgtttaccgtgccaattttatctattacccgtaaaaaggaattgccgcaataagcataacctctttggggtgataagtaatattataagaaacatacttggagatttcatgtggaaatgcagatggaaattcgtttgagaaaaatgtgagtatttcttccagccgaatgtttgcatcggattccgtgtctcttccacgtttgaacactcccggagtgtgtccgccaaatcagagacaatgagcaaactttctagtggcggctaatgctgctgcttcacagacactataaaatcgcgcgaaccgaaactcgctgccatctgctattgaaaataaggcagatggcagcgagtttcggttcgcgcgattatgttttattcagcagcggcaaaagcgccacacgaaagttcttaaattgtctcatgatttgcggacacagtccgtggagtgctccaaacttggaaagacatggatcatcgcagattgcaaacatccggctggttagaaatgccacattttttgaaccgaattttcatctgcatttccatctgaaatcccacggtgtggtcttttaataatattacttatcagcgcaaagtacaatacgcttattgcgacaatccccttttagaagatcactcgtcgtccgccggtaaaaattcaacgtggtccgtatccattgcaccgactctggcaagtgcatacacttcggttccctgatcaaccagcttttcacgtcctggctggaaagacttttccaccagaacgccgagaccggcgatggtcgcatgtgccagacgcagaagacggatcgctccggtcgcagcctcaccgtttgcaaggaaatcatcgatgattaagacgtgatcctcctcggagatgtacttcttggagagcgtcagctcgtagttcgtctctttggtaaaggatgtgatcacagtctggtagagattatcatttaaaatctgagaaggctgcttcttcaaaattaccataggaacgcccagcgcagatgcggtcatgagtgcaggagcaattccagaactttcgatagtaaccactttcgtgatgcctctgcctttaaaatgtgcggcaaatgcctccccgatctgtgccatgagcaccggatccacctgatgattgataaaactgtctaccttaagaatgtctttgtttaatgcctttccctcggaaagaatcttttcttccagtaatttcaaaatcgtcacctctcaatagtatatttgatggttctattgtaccataagtcgctgcatgaaagaagtgctgttttggagaaatgtcccgattttagaaaagctcggcgtagagcagttcaatcatatgatcggtaaaggattccgaaagggagggatactgatgaagcagcagcttttccatcacttcgtagcgggaaaaatacagcgcctcctccggctgatcgttgtcgacggactgatcaatgacatcggcacggtaggtatccagaaaccatttgaggatctcatcctgcagtgcatcttctgttgcagtcgcatctttgagctgtttgatctgtccgaaggaacggatgccgatccacaaaaagataacgaacatgattcccatgacaagacccatcagaattctggcggcaccggtaatatggatcggaagaacgccgcagaaaaacagcactaaaagaaccagtccgatgatgccgaccccggtaaaggtgtaggcggtagacttcatatcttcggtctgggaagccttggaccggtaggcgtgtgaatgtgcagtaagcggcggagtatctcctctgccgccttccgctgccctgacggtggaagctgccgaaagttcttccatgtcatcaggggagaaggcatccggactgtcttttgatttgtcctctgatatggagagcgactccaccagatccacgccgcagtccggacagcggacgattcccgctacatattcgtttttacattctggacaccacataataagttctcgctttcttagttttcttttcctatattataggagattttatagactgccgcaaccaaagaatgttataatgaacctgctatgaagattacaattttatgcgttggaaaaatcaaagaaaaattttacagagatgccatcgaggaatacgctaagcgcctgacgcgctattgcaagctggaaatcatcgaggtcgcagatgaaaagacgccagacggcgcaagtgccacggaagaaatgcagatccggcaaaaggagggggagcgtgtgcttgcccgcctcgagaaatgcaggcagagcagctcctatgtcatggcactcgccatagacggcagagaactcgattcggtcgaactctcacagaaactggaaaaactgggaactgacgggatcagcaatgtgatctttttgatcggtgggtcactcggcatgtcaaaagagctgcttgcggcggcggattttaagctctctttttccagaatgacgtttccacaccagctgatgcgcgtgattctgctggagcagatctaccgcggctaccgcatcatgaaccgggaaccctaccacaaatagcggcaggctattcggtaaagtccctggaatacagaacggttccgtccggatttaaggcggtcagccggatggcgatgccgtttatgccggtctcatctgcaatctgcgcgcgcagcgaggaaaaagtggaggcatagctgtcaaaaatggcgtcatacagctgcgtcagtgcgtcggcgtctgcatcatccgacatatcatacgccttagaaagcgtgtactggaacactaacgcatcggaatctgcggtgacaatgtccagggtgtatcccagatcctgggaattgacggcgtctgtcatctcctgaaactgatccgcctgtgtggcataccagtcatccagcgatgcttttttacatcccatcagagccattcccaagcaaaaaagtgcgagcacgcacagtaatattctgtggctttgaatttgatatccggtcataacggtctccttttccctgtagaagcttaaaaatctatcatcagtatagaagtccgccgcacgacttgtcaagcgtccgcgcggcaaatgttgaatcggcggttaaacggtgttacaataaagtatactttagaaataagggggattgcagtatgagaatgtatgatttgatcttaaaaaagaagcagggcggggaactttccacggatgagatccgctatatgatagaaggttttacggagggaagcattccggattatcagatgtccgccatgacaatggcgatctgttttcgcggaatgacgccgcgcgagacggtggatttaacgcttgccatgagggacagcggtgatgtgctggatctctcggggatcaagggggtaaaggtcgataagcacagcaccggaggcgtgggagacaagacctcactggcgctgacaccgatcattgctgcgctcggggttccggttgcgaaaatgtccggcaggggactggggcataccggcggaacaatcgacaagttagaatgttttgacgggtttacgaccgcgctctccgaggagcagtttgccgggaatgtcaataccatcgggattgccattgcgggacagactgccaatctggcgccggcggacaagaaattatacgcgctgcgtgatgtgacggcaacggtggatcagatgtcgctcattgccagctccatcatgagcaaaaagctggcgtccggaagcgatgccatcgttctggatgtcaagacgggcaacggcgcttttatgaaaaagcttgaggattccagagcgctcgcaaaagagatggtctccatcggtacgatggcgggcaagaagacggtggctgtcatcacggatatggatcagccgttgggacgcgcggtcggcaattcacttgaggtccgggaagcgattgataccctgcgcggagagggaccggctgatttcaaagaagtggtgtttgcactgggcagccagatgcttatgctcgcagggcgggcggcggacgaaaaggaagcccgcgcactgatggagggcgtgatagaagacggatcggcactcgataaatttgcccagttcgtgcgcgcacagggcggagatgctgcaccggtctatgacacatcccttctgccggttgcggggaagacactagaggtcacggcaaaagagagcggatatgtgcaccggattctggcggaagacatcggaattgcctgcatgaccctgggaggcggaagagagaccaaggagagtgcgattgatctatccgttggtattattctggagaaaaagaacggggatgcggtaagtgacggtgaagtgcttgcgacgatttatggcaatgatgatgccaaaatgcaggcggcgtatgaaaaaattgcccatgcctacgagatcgccaaagagccggcggctttcgtgccggtggtcagagaatatatctttccagaataagacggtatttttcctcatatagtgctatatgagaaaaaatagcagaacttcagcggggtcacagatttcgctgcgcgaaagaattgtagataacctggagcttcccaaagacctcatgctcggggcggcgatcgtgaccgtcaccggcagaggggaagctgtgatttcaaattataaaggaatcctggaatacgaggattcctttatccgggtgcagacaaaaacctgcaggatacggattaccggtgtccgtcttgccatagattattacacgaatgaagaaatgaaaataacgggcagcattgatacgatagagtacgagaactgagacgatgttgctctctgtgatcaaatattttcgcggttatgttcatgtgaagctgacgggatatgcaccggaacggttcttaaatctgtgcgggaaccggaatatcctgatctggaatttaaaaccgtgtgaaaatggatatactttttgtatcagtgtcgatgcattccgacagctgaagcccattctgaaaaaaaccaaaacgcagatccggattcagaagcgtgtggggatgccgttttgcgcgtttcgctaccgcagacggtatcttttcccggcaggcctgctttttttctgctttttgctgtatgatctgtccggattcatctggaatatcgaaatcaacgggaattcttatctgaccacggagacgattctggatttcctggaggaggaacacgcatcgtttggaacgaaaaaatcccagatttcgtgcgaggatctggaagaagccatgcggagccgctaccgggatgtcatctggacttccatcaagatttatggtacaaagatgacggtcgatattcaggaaaacctcctgtcgcaggaagaatatgaggcgaagagcgatgaaccgcaggacattgtcgccgccaaagacggcgtgattaccgagatggtgacacgcgcgggcacgccgcttaccgcggtgggagcggaggtaaagaaaggcgacatcttagtctcggggcgcattgaagtgttaaacgacgacggtgagatcatgcagtacctctaccgtccgtccgatgcggacatcaaggcgaaggtactctattcctaccgggatgtgattgatggcacctgggtggagatggcaccgaccgggaacacgaaggagcgttacagcatcacgctgcttgataacgtgttcgactggccgcttttccggaatccgtttgcagagtatcaggtgcagacggagagcaggcagctccatgtggcggacaatttttatctgcccgtgtggctgaataaaagtgagttcacagaggtcgagcaggtgcggcacgagcgcaccgaagcggagatccgtcagattgccacaaagaatttctcggattacatcaaagatttggaagaaaaaggtattcaaattatatcaaaaaatgttattataaaaagtacgggtgaaaaatatgtggtaagcggcgatctgtgggcgcacgaatccattgtttcctatcagccgacagaggtttacgataccacaatgcaagaaaggcagaatgaaaatgagtctgactgaagtttcgttaaatataccgacagaccacatggcgaatgtgttcggtcagtttgatgtctatatcaaaaaaatcgagcgtaccttgaatgtgacggtggttgtccggggagaagatatgaaaatcctcggagacgaaagacgctgcaggcgcgcgcaggatgttttcatgcagcttctggaattgtccaaacgcggaaatgtcatcacggaacagaatgtcaactatgcactggcattgatggcggaggaaaaagagtcggcgatcgtggagatcgaccgcgactgcatctgccacacgatcaacggcaagccggtaaagcccaagacactcggtcagaaagcctatgtggatgccatccgcgaaaagatgatcgtgttcggcatgggaccggcgggtaccggtaagacctatctggcgatggcgatggcaatcaccgcgtttaaaaacgaggaggtcgggcggattatccttaccaggcctgcgattgaggcgggggagaagcttggcttccttccgggcgatctgcagagcaaggttgatccttacttaagaccgctttacgacgcgctgtatcagattatgggggcggaaagcttccagaagaatatggaaaagggattgattgaggtggctccgcttgcctacatgcgcggacgtacgttagataacgcatttatcattctggacgaggcgcagaacacgacgccggcgcagatgaagatgtttctgaccagaatcggtttcggttcaaaggcggtcatcaccggtgacgccacccagaaggatctggcgccggatgccgcatcgggcttggacattgcgctgaaagtgctgcgcaatgtggaggagatcggtatctgcgaactgacaagccaggatgtcgtgcggcatccggtggtgcagaagattgtcaaggcatacgaggattatgagaagcgcgccggtaagacgtccggcacgagaaagaacacgagcagaaccggagcgggcagaaccggtgcgagaagcaggagagagaacacgaatggatgatcgctatgtggcaaagagagtaatatatctgcttggcatgtctgccgcaacgatcctgtttacgacagcggcggcatttatcaggggacagtatctcgacgagtggatcgtccttgttatcatcaatctggtatttctggcgttgtggttctttttattggagcactgccggatgaagcggagcattgcgggaaaccgtgagacaagctaccggcgtatttttgcagggtatctggcgtcgcttggcgtgacggcggtctgtcttgtacttccggaattttcaagacctgtgatgctatctgccattttgatgctcggtgtggggaatatcgagctttccctgtgcagcggactctttttctgcagcctgctcggtcttttgtgcggtggaaccatccaggaattctccatgtatatcctgctggttctgatcggagcggtggcagcggacgcagtggaaaacagcaaaaagcagttctggtatgaatggtttgctggcatggcaggcatgcttcttccggttctgttctactatctgacctaccgggagatcagtgtccggatcatggtatctgccgtggcggacggtgtggtcgtctttttgtttttgcatctgtgctaccggaagttagcggatgcaagaaatgcggaagtcgatgaggtcatggtcgacatcaccgatgaatcctatccgctggcgcgggaactggcgagtttttccagggcagactacagccatgcaaggcgggtaatgcttgtggcggcgcgatgtgctgctgtggtcggggcagacgaacgtgtgtgcagcgccgcggggatgtattaccgtatcggcgtactggagggcgcaccgcttgcaaaaaacggtgtgaaaatggcacagagagcctgcttcccggagaaggtaatccgcattatcggggaatacaacggggaagaggccctgccatccaccatcgagtcggcgattgtacatatggtggacgggctgttgaaaaaactggaggttctggatgaggataccgttggcagcaactggaaccaggatatggtgatctatcagaccttgaatgaatattctgccgcggggctgtatgaccgttccgggcttagcatgaatatgtttttgaaaatacgggaatatcttgtgaacgaggaggcattactggtatgagcctgaatttagaagtcgaagtggacgtgccatttacatttgattatgaagcgctggcgggcgaggttgtcgcttttaccatcgaccatgaaggttttccttatgaggcggaagtgaatctgacgctgacggacaatgaaggaattcatgagatcaaccggatgtaccgacagattgatgcaccgacggacgttttgtctttcccgatgctctcctatgagcaggcgggcgatttctcggcgttggaagaggattatgaggataattttaatccggataccggggagatcatgctgggagacattgtcatctcggtggaccgggtgagagagcaggctgccgcctacggacacagcgagcgcagggaatttgcgtttctgatcgtgcacagcatgcttcatctgttcgggtatgaccacatgacgccggaggacgcggcagtcatggagccgaagcagagacagattctggaggagatgaacatctcgcgtgattaacgaacggcggcgccgtggcgcttccgaaaggatttgaggtacttttatgggcaataaaaaaaggaaaaatacgacaagttttctggcgcagggcacaatcctcgcggcggcttcgctgatcagccgtgtgatcggcctgatttaccgcatgccgctgacggcgattattggggataccggcaacgactattatggcagtgcctataccatctataatattttgttaattatttcgtcctacagcctgccgctcgcggtatccaaacttgtctcggcaaatatctcacagggcagaaggcgcaatgtctaccgcatcttaaagtgcgcgctgatttttgcgctggtgtccggaaccgctgccgcggcaattctctatttcggagcggattttattacgggtacgctgcttagaaccccactttgtatctttgcgttaaaggttttagtgccggttcttgtaattgttgcggtcttaggtgtgatgcgaggctttttccagggacttggcacgatgatgccgagtgccgtatcccagatcttagagcagattgtaaatgcgattgtcagcgtgtgggcggcgtatgtccttttttcctacggttccaaagccggagcgcttttaggcaatgccgaggattacggcgcagcctacggtgcggcgggcggaacgatcggaaccgctgccggagcgctgagtgcgctgctgtttgcgggttttgtccttgttgtctatctgcgggtgtttaaaaagacgcttcgcaaggagcggaagacaagcgcagattcgtacggagagatttttaaactgctgatcatcaccattattccggtgctggtgagcagcacgatctacaactgcaacgccaccattgaccaggcggtctacaagaatatcgcggcatggcagggatattccaagacggactacggtacctggaacggtatctataccggaaaataccaggtgttaatcaatgtgccgctggccattgcatcctcccttgcggcatcgagtgtgccggcgctctctgctgcttatgcgagcggaaaacgaggcgaggcgaaacggcagattgggcttgccacacgctttatcatggtcgtggcattcccgtgtgcagtcggaatgggcgtgcttgcctccccgattcttcagatgctgtttggtgattcctccgagcttgcggcaagaatgctgcagaccggttccgtggccatcattttcttctccctgtcgaccctttccaacggtctgctgcaggggatgaatcggatgaaggagccgatcaagaatgcagtgattgcactggcgcttcacttgatcattctggtggcgctgatgcttgggctggatctgaacatttttgcggtgatcatcgcaaatgcatgcttcggactgatcatgtgtattctaaatgcgcgctcgatccgccgttacagcggataccgtcaggaagtgcggcgcacgtttttcgtgccggcggtttcagcggctggaatgggcgtggtggtatggcttgtttaccgtctgttcctctatctgcttcggagcaatctgatcgcaacgcttgtatcgattgttgcaggcgtctttacctacgcgacgctgcttttgatgcttaagggactgaccgagcaggaaatcctgcgcttcccgaaaggcagaacgcttgtaaaactcgcgcggaagatgcatcttttgcgttaattgaataaaaaggaaagaactggcagatacttatcgcagagaatgggaggacattatgaaacggacgataggtatttgcctttttgcggcagtgatgctgtttgccggaggcttgtgcgggaaaaacgcatttgatgcagaaaggatccgtacggcagaggagacggaggcggtcacggaagatgccgcagtgacacagacggagcggactgcggagagcatgcagatccagaaaacctgccgctatctgctccgcatggatgacgacggcatcttaaaagtctatgaggcggacgggataacccttttatttgagaccaacatccgtgcggaacggctttccgtgcagacgagggagcagctttccgacggaattccggtagacgatgagagagaactgtacgatctgctcgaaagctattccagctgacgtaagagaagttattcattgaatgttacagggctgtgtggtaaaattgttacggttaagaagaacggacagaatgatacagcggttagataagaggttgaaatgacagatatagatgttacggtgatcggtggcggcgcggcaggacttatggcggcggtcagtgcagccaggtgcggcgcgagaacacgggtgatcgaacacatggaccggattggaaaaaagattctatccaccggcaacggaaaatgtaattacacaaatgcagtgcaggggctttcctgttatcgtggagagaaccctgcttttgtgctgcctgtttttgagcagttcgggcaggaggataccgtgcgcctgtttgaagaacttggaatctatccgaagatcaaaaacggttactattatccggcgagtgagcaggcggtgtctgtcgtggaagtgtttggcatggaatgcgattacctcggcgttgatctgtggacgtcctgcggactgcaatccattcaaaaaacctgtaccgggtatgaaatacgcaccacaaaaggcgcgttttcaaccaaaacagtgatttttgcgcccggattgctggcagcacccaagacaggaagcgacggaagtgcatttccatatatagaagcacttggtcatcattttgtagatgtggtgccagctctcgtgcaactgcatggaaaacaggcatttttcaagaaacttgcaggaattcgtgcagaaatgcaggtaacactctacctggaaaatgcgcaatttcaaccaaaaggcagccgtgggacagcccggggagaaaagcctgacacggtgtgcagtgagcggggcgaacttcagcttacggcttccggaatctcgggtatcccggtctttcagatcagccgttatgcgacaagagcgctcgcggacgaaaagcatccctacgtgctgattgattttgcgccggatcttacggacaaggagttttttgacctgctgtcagagcgcttctacgagaatacacatggcaagagcgccggggaggcactgatcggtctctttaacagaaagctgagcgaggtactgctctccgaagctggcatacggtcggaactctatgccggggaggtggcacgcgccacgttgcaccggctggtgaagtgtgtcaagaatttccgggttgatattaccggaagcaacggaatggaagcggcgcaggtatgcgcagggggcgttgacacggaggagattgaagctacaacgcttgcgtcaaagctggcagacggtatctattttgcgggcgaggtcattgatattgacggcacctgcggcggttacaatctgcagtgggcgtggtcgagcggctttgtggcggggatgcatgcagcagaggaaggaatgtcagaacagagatgatacggatcaatcagataaaaatgccgctgcatcacaatgcggcagcactggaacagaaaatcagaaaacgtctgggactttcgggagaccaggagcttcgctaccggattatcagaaaatccattgacgcgagaaagaaaccggaactgtcgttggtgtattccgtggaggtttccacttccggagaagagaaaatcataaaaagggcaaacgatccgaatgttacgatcgtaaagcagaccggttatcatctgcccggggcggtttcgccaacgccgtccatcccgccggtgattgtcggtgcgggtcctgcgggacttttctgcgcgtatgcgctcacgatgagcggctgtgcaccggttgtccttgagcgcgggcgttcagtgacggagcgcacaaaggatgtggagcgcttctgggagagcggagtgttggatacggtttccaacgtgcagttcggagagggcggcgcaggaactttttcggacggcaaattaaatacactggtcaaggatcccaccggcaggaaccggtttgttctggaaacctttgtgaaattcggagcgccggagcagattctgtacgaaaacaaaccgcacatcggaacggatattcttgccggagtcatcaaaaacatgcggcaggcgatggaagcgcgcggcgccaggttttgctttgagagttgtatgacagattaccgcagggaagcggacggaaagatgtttgttgaggtcaaccacaaggagtggatcgagacttccagactcgttcttgcaatcggtcacagtgcgcgggacacgtttgggatgctgtatcagaagcaggatcttgtcatggaggcaaaagcgtttgcggttggtttccgtgtggaacacccgcaggagatgatgaatctgcagcaatatggagcgctgcatgcacacgaacttccggcagccccctacaaagtgacagcgaacctcgcaaacggcagaggcgtgtattccttctgcatgtgtccgggcggatatgtggtaaacgcatcctccgaggaaggcaggcttgcggtcaatggaatgagctattccggacgtgacgggaaaaacgcaaacagtgcgattattgtggcggtaactcctgacgactttgcggggaaagatccgctagccggtgtccgttttcaggagatgctcgaggagcgggcattcgctatcggaaaagggcggattccgcagcagctttttggagactattgcagcaatcgtgcctcggtgtcttacggggcgtttgagagcgccacaaagggcgcatgtgtgcttggcaatttaagaggtctgctgccgcaggcactggaagagtcctttatcgaggggatgcacgcattcagccgccggattccggcttttgaccgggaagacgccatcctctccggcgtggagagccggacgtcctcaccggtgcgcctggtgcgcgatccgaagcttcttgtggctgcaggcggcatctatccgtgtggggagggcgcgggctatgcaggcggcatcatgtccgcggcgatggacggactgaaagtggcagaggcgattatgagagatatggaggagcaacgtggctgaatttacaccaatgatgcagcaatatctgcagacgaaggaagaatataaagactgtatcctgttttaccggctgggagatttctacgagatgttttttgaggatgccgaactggtgtccaaagaactggaactgacgctgaccggaaaaaactgcggcatggaggagcgcgcaccgatgtgcggcatcccgtaccatgcggtggagggatacttaaataaacttgtggcaaacggacacaaggttgccatctgcgagcaggtggaagatccgaagctggcaaagggactggtcaagcgcgaggtcatccggatcgtgacgccgggaacgaacctggatatgcaggcgctggacgaatccaagaacaattatattatgtgcatcgtgtatctggcagaccgctacggcgtatccattgcggacgtctcaaccggagactactatgtcaccgaggtggattcggagcggaagcttttcgatgagatcacaaaattttcgccatctgaaattatatgcaacgaaagtttttatatgagtggtgtcgatatagaagatttaaggcatcgactcaagattacaatttatgcgctggagacatggtattttggggatgagcttgcagagacaacactgcttacacactttaaggtaaagagtctggaggcgctgggacttgccgattatgactgcggcatgattgctgcgggagcactgttaaagtatctgtacgagacacagaagaacgatctcaacaacatttccgtgattcatccgtattccaccggaaaatacatgatcatcgacagctcgaccagaaggaatctggagcttgtggaaacgctgcgcgagaagcagaaacgcggatcgctcctgtgggtgcttgacaagacgaagacggcgatgggtgccagactgctccgctcctatgtggaacagccgctgattgacaaggcggagatcgagaagcgccaggatgcaatctgtgagctgaatcagcacgtgattaccagagaggaactccgggaatatttaaatccgatctacgatctggagcgtctgattacgcgtgttacatatctgaccgccaatcccagggatctcattgccttccgcagttcgattgccatgctgccgccgatcaagagtcttttgggcgattttcagtgcgagctgctgggagaaatccgcgaggacatggatacgttggaggagctctgcgcactgatcgaccgggctatcatggaggaaccgcccatttcggtgcgggacggcggtctgatcaaggacggctacaacgaggatgtcgataaataccgcaaggcgaagacggaggggaagacctggctggcggaactggaagccaaagagcgtgaaaagacaggcatcaagaatttaaaaatcaaatataacaaggtattcggctattatctggaagtgaccaactcctacaaggatctggttccagattattttatgcgcaagcagacgctcgccaacgccgagcgctatatcacgccggaattaaaagaactggaggacatgattctcggcgcggaggacaagcttgtcacattagagtacgatctcttctgtgaggtgcggagtacgatcgctgcggaggttgtgcgcatccagcggaccgccaaggcggttgccggtctggatgtattcgtgtcgctcgcacttgtcgcggatcagaataattactgccgtccgaaaatcaacgagaacggcatcattgacatcaagggcggacgtcatccggtggtcgagaagatgatcaacaacgatatgtttattgacaatgacacgtacctcgacaacggcaatcaccgcatctcgatcattacgggaccgaacatggcgggaaaatccacctatatgcgccagacggcgctgatcgttctgatggcgcagcttggcagctatgtgcctgcggcatccgcgaagatcggtatcgtggaccgcattttcacacgtgtgggagcgtcggatgatcttgccagcgggcagagtacgtttatggtggagatgaatgaggttgcaaatattctgcgcaacgctacctccaactcgctgctgatcttggatgaaatcgggcgcggcacaagcacctacgacgggctgagcattgcctgggcggtggtggagcatatcagcaacccgaagctcctcggtgccaagacgctttttgccacacattatcatgaactgacagagctggaaggcaaattaaacaacgtcaacaattactgcgtggcggtaaaggaaaagggcgatgacattgtatttctccgcaaaatcgtaaagggcggcgcggacaagagttacggtatccaggtggcaaagcttgccggcgtgccggattctgtcattgcgcgtgccaaggagatcgtggaggaattaagtgccaacgacatcacggaagttgcgagaaatatctccgtcgatacgggaagcaaaaagaaaaaagaaaagctggacgaggtggatctgacgcagatgtcgttgtttgataccgtgcgggacgatgacatcatagaggaactgcggaatgtggatgtcggaaatctgacgccgattgaggctttaaacaaattatacgaacttcagaacaaggtaaagaaccgctggtaaccggaagcgcctttggcaaaggcagatgggaggaatggaatgccgcagataacactgctttcgcaggaaacaatcgataaaatagcagccggggaggtggtggaacggccgtcctcggtggtcaaggagcttgtcgagaacgcgatcgatgcccgggcaaccgccgtcacggtcgagatcaaggagggcggcacaacgttcgtgcgcattacggataacggctgcggaattgagcgtgagcaggtaccgctcgcgtttctgcgccattccaccagcaagattaagagtgtggaagaccttttatgcatccattcgctcgggtttcgcggtgaggcgctctcaagcattgccgccgtatcgcaggtggagctgattaccaagacttacagcgatctgaccggaacgcgctatgtcattgaaggctcaagagagatgagcaacgatgagatcggcgcgccggacggcacgaccttcatcgtcagaaacctcttttacaatacgccggcacggaaaaagtttttaaaaaccgcgcagacggagggaaattatatcagtgacctgatagagcgccttgccttgtcccatccggatgtctcttttaagtttatcagcaacggacagaccaagatgcatacctccggcaactccaatgaaaaagatctgatctatcatatctacgggcgcgatattacggcggcgcttcttccggtctgcgcagagacagaatatttctcggtaaagggctttgtcggaaaaccgatgatttcccgcggaaaccgcagctacgaaagctattttatcaatggacgctacatcaaaagcgcactgctctccaaagcggtggaagaggcgtacaagggctttatgatgcagcatcagtatccgttctgcgtgctgtattttaccatggatacggagcttttggacgtcaatgtgcatccgaccaagatggagcttcgtttttccaacaatgaggaagtgtaccggaagctatatcagacgatccgcgatgtgctgactcacaaggaatttattccggctgtcccggtggaggaaaagaaagaagaaaagcggccagccattaccggtagcctgccggagccatttgagacaaaacgtctgcatatcccgccgcagacacaggtgctgccgcaggggcagaacgtgacgccggaaccagtcagaacaccggaaaatctggacgtgttccggcagcttctggtgcgggaggagagcagctatcatgcggattccgcatctgcgggttctgcttcggccgaagacggcagccggatacaggagatgtcatgggaagcggaatgcataccggcggcggataccgtacagccggatgtgcagccggagccgattcctaaggcagaggccgtgcggggaactcctgatacaccggagaatctgaatacgccggagaatctgaatatgccggagaatctgaatatgccggagacagacacacagaatgtgcaggagacgcagaatccgcaggagacagcggacacggtcgtgtacgagcagcagacgctcgaggcggcggacaccggatttttcacgccggatgcagccagacggcaccggatcatcggcgaagtgtttgacacctactggctgattgaatacgaggataagctgttcattatcgaccagcatgccgcccatgaaaaagtgctctatgagcgcaccatggcgcgcgtccgcacacagaattttgcctcgcagacgctaagcccgccgatcattctgacgttgagcgccgaggaacaggaaatgcttacacgctacggggagcagatccgtctgttcggttatgaggtggagccgttcggcggcaaggaatttgccatcacggcgattccagccgattttgaggcggtcgatatgaaaggcatgttcttggacatgctggacgattttaccaacataagcggcagggaagcaccggaactgatcttggagaaggtggcttccatgtcctgcaaggcggcgatcaagggaggcgattccatcagcagggcggaggcagaacagctgatcgacgagttgctgtccctggagaatccctaccattgtccgcacgggcggccgaccattatctccatgagcaaatatgagattgaaaagaagtttaagaggattgtatgacaatgaaaccaaatcccatggtaattctgaccggcccgacagcggtcgggaagacagcgctttccattgcactggcgaaaaaaataaacggagccattatatctgcggattccatgcaggtgtataaatacatggatatcggctcggcaaaaatcatgccggaggagatggacggcgtccggcactatcttgtggacgaactggatccatccgatgagttccatgtcgtccgttttgtggagatggcaaagcaggcgttaaaagagattacggcaaacggtcagatccccattgtggtgggcggaaccggattctatatccaggcgctgctctacgatattgattttacggagcaggagtgtgacagtgcataccgcaggcagctggaagagctggcagagacacgcgggaatcattatcttcacgaaatgctaaaggcggtagatccggcatctgcagaggcgatccacgagaataaccgcaagcgcgtcatccgcgccctggaattttaccatgagtccggcgagcggatctccgagcataacgagcgggagagccagaagacatccccctacaactttgcctattttgtcttaaatgacgaccgcgaaaagctttaccgccgcatcgatgcgcgcgttgatgccatggtaaaggctgggcttgtcgatgaggtggcaaggctgcagcagatgggctgccatgcggatatggtgtccatgcagggacttggctataaagagatactggcgtatttaaacggcaccagcaccctggaggaagcgatctatatcatcaagcgcgaatcgagacattttgccaagcggcagctgacctggttccgcagggagcgggatgtcatctggctgaacaagccggattttgagtatgacgatacaaaaatacttacatacatgatggatgtgttacaggcgaaaggaattttgccggcataaaagagaggtacagagatatgaatcagttattacaggaacaatacgagcgtctggggatttccccggaggtaagtgcattcggggaaaaaatagaagcttccttgaagcagcgttttgaagagattgatgcacgcgcagaatacaaccagctaaaagtgttaaaagccatgcaggacaaccgtgtctcggcagaatgtttcaatacgacttccgggtacggctacaacgatctgggcagagacaccctggaaaaagtctatgcctcctgcttcggcggggaggatgcgctggtgcgtccgcagatcacgtgcggcacccacgcgctggcgctggctctgatgtccaatctgcggccgggcgatgaactgttatccccggtcggcaagccatacgatacgctggaggaggtcatcggcatccggccgtccaagggatcgctcgccgagtacggcattacctaccgtcaggtggatctgcttgcggacggagagtttgactatgaaggcatccgcgccgccatcaacgagcgcacgcatcttgtcaccatccagcgttccaagggatatgcgccgcgcaagacgctctctgtggagcgcatcggaaaactgatcgcattcatcaaggacatcaaaccggacgtgatctgcatggtcgacaactgctacggcgaattcgtggaagagcgtgagccgattgaggtcggggcagacatgattgtcggttccctcatcaagaatccgggcggcggacttgcaccgatcggcggctatattgtcggcaaaaaagaatgtgtggaaaatgcggcataccgtctgacttccccgggactcggcaaggaggtcggcgcttccctcggcattctgcagtcgttctaccagggactgttcctggcaccgaccgtggtgagcggcgcgttaaagggcgctatttttgcggcaaatatttatgaaaagctgggatttgacgttgtgccggacggcagtgagagccgtcacgacatcatccaggcgatttccttccacaatccggacgcactgatcgccttctgcgagggaattcaggctgcggcgcctgtggacagctacgtgacgccggaaccgtgggcgatgccgggctacgacagcgatgtcatcatggcggcaggtgcatttgtgcagggttcctccatcgaactgtctgccgacggaccaatcaaaccgccgtatgccgtgtattttcagggcggtctgacctggtaccatgcgaaactcggcattttgaaatctttacaaaaacttaaggaacgaaaacttgtgaatctggatgcgttatgctaaaatataatgtaagtttttgtcccgtaattggttgacataaattctacaaaccatcatagggaattgccggggagagacgggaaatctttatgaatcatcattttacaacggttaaggaactgccggactcggagaagccatatgagaagtttttaatatccggggtcgaatccttaagcgatgcggagctgattgccgtcatcatacgttcagggacgcgcgggacgcgttctgtggaagtggcgcaggaattgctgcggcaggacggacacgatctgttgaatctctacacgttatctgttcaggatatgcagaagattcccggaatcggacaggtgaaggcgatccagttaaaatgcattgcagaattatccaaacggatggcgaagacgcgctataaagagcgcatctgtcttggcgatccgggctccattgcaagttattacatggaggatatgcggcatgagagcagagagcgtacgatggtgcttctctttgacgccaaatgccgcctgctggagaaggttatgatgtctgtcggtagtgcgacggctgcacttgtctcaccgcgcgagatttttctcgctgcattggacaaaagtgcgattcagattgtgctgatgcacaatcatcccagcggtgatccctccccttcggcggaggacgatgcagtgacaaagagagtggcggagtgcggagcgcttcttggcatccctcttgtggatcacattattatcggtgaccgcacgtactacagctacagagaatgcaaaagaatacaataaagggagagaacaatgacgaataacgtgtatggtattgaccttggtacctgcaatatgaagatttattgtaaggcgtccaacaagattatgaacgagaagaacaccatcgctctggtgaataagaatgagatgtatgcctacggtgatgacgcttatgcaatgtatgagaaggcaccggaaacgattcaggtgacattcccggttgtgggaggcgtgattgcggattttaataatcttcaggtaatgcttcagacttatctggagacccacgccaagggcaagctgcgcggagcggaattcattgttgctgttccaacagatattacggacgtggagaagcgtgcatttttcgacatgttctacaagagcaaattaaagccaaagagcgtgctgttatgtgagaagccgatcgcagatgccgtcggtctcggtctaaacgtcaacgagccgaccggtattatggtggtagacatcggtgcggataccacagagatttccgtcatctcgctgggcgggctggtcttaagtgatctgttacattccggcggcaacaagatcgacgaatccattatcacttatgtgaagcgcaagtacaatcttgtcatcggacagaagaccgcgcagagcatgaaggagaccctcggaagcggtatcccgggcaacacccagaccatggtggttgtcggacgcgacgtggtgagtggtctgccgattgagatggagatgtcgggagctgttgtctatgaggcgatcaaggacaacctcaacacgatctgcaattccatcaaaatgatcctggagaagacgccgcctgaacttgcaagagacattattcattccggcatctatatcacgggaggaagctccaagattcatgatctggatcagctgttccgtgatattacaggaatcgagatcaatacctgcgaggagccggaggagtgtgtggtgcgcggactcttaaagatcgtatccgatgccaagtttaagcatctggcattcagtatgaagaataagatattgttatagaggaaattatgaaacggaaacccaaaattgttttgcctgccaagtacatattgctgattctgaccgttgtctgcgtggcagccatgattaccagctttacgctcaatatctccggcggtccgctcaacgcggttgccggttatgtgtttgttcccatgcagcgcgggatcaacacggtcggcgcatggattacggagaaagccgacaatcttaaaaatttaagcgatgtcatggcggaaaacgatgcgctcaaaaagcaggtggatgagcttacctccgaactgaataccaacaatctggagcagtatgagcttgagaatctgcgcgagcttctggcactggaccagaaatacccgagctatgagaaggtggctgccaatgtcatcggcaagagcagcgggaactggttttcctatttcacgatcgacaagggaaccgacgacggaattgaagtcgacatgaatgtgatcgccggcagcggacttgtcggcattgtcacggacgtcggcccgaattatgccaaagtcacttccattatcaacgatacggcgcagatcagcggtatggtgacgacaacctccgacaacctgatcgtaaacggaagtctccagaacatgaatgagaacatggtcatcgagttttccaatttgaatgacagcgacaataaggtggcggttggcgaccctgttgtcacgtcctacatttcagataaatatcagcagggaatcttaatcggctacatcagcagtctttcgacggattccaacaaccttaccaaatccggcacgatcacgccggcagtggattttgagcatatcgaagaggttcttgtcattctggacaagaagcagtcagccggggagtaggattcatattatgagaagaaaagtaaatgtgtttattatcattgcaatctgtttcctgcttcagaccacgctgtttcaggcattgtctttcgcatcgatctcgccgaaccttctgattatcgtcgtgtcgtccttcgggtttatgcgtgggaaaaaagaaggaatgtatatcggttttgcctgtgggcttctgcttgatatcttcggcagcggaattcttggattttatgcgctgctctatatgtatatcggctacatcaacggctgtttccgcaaaatgttttacccggaagacttaaagctgcccatgcttttgattgccggcagtgatctgggatgcaatctgttgatctactttttcttgtttttgttccgcaatcgttatcattttcaatattatctgtggaacatcatgttgccggaacttgtctacaccatgctgattacgatctttttgtatgtgattatcctgaaagtcaaccagcggcttgagacattggaaaaaaggagtgcaagtaagtttgtttgagaatataaaagaagttttccgcatgttttttaaatcgagacttgccgttgctgccgttcttatgacggtgctgttcggtgtgcttttgtggcgcgtgttctacctacagatcgtaaagggcgagaaatatcaggacaactacaccttaaagatcgtaaaagagcggaccttgaacagtacgcgcggcaatatctacgaccgcaacggcgaactgctcgcatacaatgagctggcttattcgatcaccatcgaggacaacggcagttacagcagcaccgataagaaaaacgaatcgttaaacgccgagattgcccaggttatcactgcactggagaaaaacggcgatgcgatcaccgatgattttaagattgaccgcaccggagagggtacctacgaattcaatgtcacaggtacctcgttaaaacgtttcctggcggatgtttacggcgagagcagttacgatgatctcggcatgaacaaaaagcttggctacgacacctcccaggcgaccgtggatcaggttatggactatctccgcaacgactgttacggcatcgacgacagctacagcgacgagatggcgttcaagatcacgatcgtgcgttttgccatggcgcagaatgcctaccagaaatatatcgcaaccacgattgcgaccaacgtatccgaagaatccgtggcgtacatcagcgagcacgcacaggaactgcagggcgttgaggtgatggatgacaccatccgcaagtacaataacagcgaatattttgcctccattctcggatacaccggtaaaatttcttccgaggaatacgccaaattatccgagacggatgacagttataccaccaacgatgtcgtcggcaagggcggcattgagcagtatatggattcctacttaaagggtgaaaaaggctacgaaaagctgtatgtcgactatctcggaaaagccatcgaggtgattgaccgcaaggagtccaaggccgggaataatctgtacctgtcattggacagtgatctgcagattgcggtatacaatcttttggagcaggagattgcgggaatcgtgtattccaatattgacaatccttcttccgatattccgatcccgatcacagatgtctactttgcgttaatcaataacaacgtcatcgatctctcacactttgacagtaccgacgcatcgacggcggagcagtcggtatccgccattttttccgcacggcaggacgtggtaaaaagccagttgagagagcagcttaccggcaacacgccgacggattttaaggatctcagcgaggaggagcaggattatttcacttatattatccggagactccgcaaaaataatattcttgccgacagcaacatcgatacctccgatgaggtctaccagcagtggcagcagggggagtgcagtccgaaagattatctaaatcacgccattgcccagaactggattgacattacccagtttacggtggatgaaaaatactcggattccacggaaatatatgatgccctgtgtaattatattctggaagagcttttctatgaaatagatttttccaagatcatttatgaatatctgattaccggcgggcagatttccgggacacagctctgtctgattctgttcgaccagggcgtgcttccgtacaacgaggaagagattgcagcgttaaacaacggctctgtgacagcggtatcgttcttaaaggaaaagatacagaatctggagatcacaccagcccagctggcattggatccgtgctcgggatcgtgtgtggtcacgaataccaagacaggagaggtgttagcgcttgtcacctacccgggatatgacagcaaccgtctggcaaacaacgtcgacaccgaatactttaacagtctgcaggatgacaaatcactcccgcagtacaattacgcgacccagcaggagaccgcaccgggatctaccttcaagatggtaacatccacggcaggtctggcggagggcagcatcacaatcggggagcgcatccgtgatctcggcgtctatgagaacgtaagcaaccatccaaaatgctggattttttcatccaacggcggaacccacggggagatcaatgtctccgaagcgcttcgtgattcctgtaactactatttctacgaggtaggataccggcttgccacgaacaattattccacggcatataacgattcgctcggcattgaaaagcttcagaaatacgcgagcctcttcggtttaaacgaacgcaccggaatcgagatcgaagaagcggcgccgcagatcgccaatgaattcccggtcatggccgctatcggacagagtaataacaactacaccacggtacagcttgccagatatgtgacagccgtcgccaatgagggaaccgtctaccagtatacactgttgaaccgcctggaggattccgacggaaatgtgttacagacatttgagccgcaggtgcgcaatcagatcgacgtgcttgatacggaagagtggaatgccatccattccggtatgcgcatggtggtggagaatacaaaagagtttgacggttttccgatcgaggcagccggaaaaaccggtacggcacagcagaatttaaagcggccgaaccacgcattatttgtgggatatgcgccttacgacgatccggaaatctcgatcgcgacgcgtatcgcatacggttatacctctcacaatgcggcgaaactcgcccggaatgtatttgcctactactttaatgtcgagaatgaagatgaactgttaaacggtcaggctgcaaacggcaattcttcatccaacgagatcagtgattaagagagaaaggcgcagacaatgagtcaggcagtcattatcaaaagcagtaaaaacggaatcaatctggtgctggatgcatcgatgccgtttccggaactgctcacagaaattcttcacaaatttacggaggcggagcgctttttcgcgaacgcatcgtttgccatctcttttgagggcagagaattaagcgatgaagaaaaataccagatcgtagacgccatcatggaacagaccagagtcaaaatcctgtgtattttagacagtgatgagatccgtgatgcggtgatcgaacagaaatgccgcgagatgcagcagacaaacgaagagaaagaggcgagaagacagagccgcggctgcttttaccgtggctcccttctgccgggagagcgccttgagaccgaggagagcatcgtcatcatcggcgatgtcccgcaggaagcggtggtggtatcccaatcggatatcgtggtgctcggcgaactctcgggaaacgcctttgccggaatgagcggcaataccaatgccacgatcacggcgctttctttcctgcccgagcagtataacattgccggcgtttacggcagtccgatggaaaaagcaaaaaattccatcttttccaagcgtaataagaccacacaggcgaaaatggctttcctctgtgacggtattattaatataaggtctttctcgtaaagactataaaaacaggaggtcttccatgggtgaagtaattacgtttacctcaggaaaaggcggcgttggcaagacgactacaacagctaacgtcggtgcgggactttcactgttagataaaaaggtggtattggtagacaccgatatcggcttaaggaacctcgatgtagtcatgggactggaaaaccggatcctctataatctggtcgatgtcctgaccgggagatgccgcgttaagcaggcgctgatccgggacaagcggtatccgaatctctggatcataccgtcttcgtgctccggtgactccaaaaacaatctgaatgaaaaacaaatgaaaaatctgctgtcggacctgcgaaaagaatttgattacgttctgattgacagtccggcgggaattgacggcggttttaagctggcgacggcggattccgaccgcattattgtggtcacaacgccgcagattgcggcgattcacgatgcggactgtgtaatccagcttctgcaccggaaaaaggtgccccggatcgatctgctggtcaacggttaccgcagacagatggtgcgtgacggcaacatgctcgatattccggatatctgtgagcttctggaagcggagcttctgggtgttgttctggaagacgaggagattatcatcagccagaaccacggggaaccggtgatcgggaagcatacggtttccgacacctgttaccagaatattgcacgccggattgccggcatggaagtcgcaataccggattatcttcatcacaaagggatgttctccagattcttctggcggaatcatgccggaaagctggtgtaggatgtgtcatagaagcaagggtgttgcaaaagagcggctgaagctgatgatcgacagccgcaggaaacagctggatgacgagaccctggcgcagatccgccacgaaattggcgaaatcgttaccagatatgtcgatattgaacccgaaaacgttgaaattaaaatcatacttaaggattacatatgttcaaacaatacaaactaaagaattacaagttcatattgattgcactggtggtgatcttaaataccatcggtgtggcgctggtgggaagtgcaagcccgggcgaccagaaaaagcagatcatcggtatggtatccgggatcatcattatgcttctggtatcctatattgattataattttatactgcgtttttcctggctgatctatctgggagccatcggtcttctggggcttgtcattgtggcaggagagcagagcaagggtgcgcagcgctggttcaagatcggcggatttcagttccagccgtccgaactggtcaagattctgatgatcctttttctggcttactattttatgcggtacgaggaaaaaataaattccccgcgggtgctgttcggatcttttatgctgatcggcattccgcttgcccttattctggcacagcccaatctttccacgaccatcgttctggcgctcgtttttgcggcgatgctgtttgccgcggggctcagttataagatcgtggtgggcgtgctggccgtgtgcgttccgaccttttttatcgtattgacgttaatcattcaggataagtttccgtttatacacagctatcagctcggacgtattatgggatggctttatccggataaatatccggatattgcctaccagcagcagaactctatcatggcgatcggttccggccttttgtggggaaaaggactcggcaataccgatcctacctccgtaaaaaacggcaagtttatactagagccgcagaacgactttattttcgccgtagcgggggaagaaatgggctttgtgggaacggtcaccattataattctcttgcttttcattacgattgagtgtatatttattgctagaaaagcaaaagatgcggcgggcagactgatctgctgcggcatggcggcattgattggatttcagagtattgtcaatatctgtgtagcgacgggattactgccgaataccggtgttacgctcccgtttgtcagctatgggcttacgtcgctatggtcattatatatcggtatagggcttgttcttaatgtaggtctgcagccgaaaaaatattaacaggggggacttaaattatgaacatcggattgattgcacatgactcaaagaaaaaactcatgcagaatttctgcattgcttatcgtggaattttatgtaaaaacgaactttatgcaacaggaacgacagggagactgatcgaggaggtcaccaacttaaacgtccacaaatatctggctggacatttaggcggcgtacagcagctcggagcacagatcgaacacaatgagatcgaccttgtgatctttctgcgcgatcccctgactccgaagtcccatgagccggatgtcaatacggttgtgcgcatctgtgatacccacaatattccgcttgcaaccaatctggcaacggccgagttgttaatcaaatcactggacagaggagacttagagtggcgtgaaatgtataaataaatggatctgtctgtcccttctgattgcagtttcctgcgtcagcggatgcggcaagacgtcagctgccatcgaacagccctatgacgtgtatgcaaccgcagcggatttcgggttgtcctcgaatggcaccgcagaggcaaagtcttattttgcgagtaatctctgcgtttcggaagatgtggcgatcggaacggattccacggattcccaggtggcagagggcgcaggcacgtttaatcttgagacaaataccgtagtgtatgccaagaatctgtatgagcggctctatcccgccagcaccacaaagattctgacggcgtacattgccttaaaatattgtgatgatctggacgctatggtgacggtcagcgagaatgccgtcaatcaggcatccgattcttccgtctgcaatttaaaagccggcgacgtgatccggcttcgggatttactatacggtctgatgctgcgcagcgggaacgacgccgcagttgccattgcggaatacatatcgggagatgtcgattcgtttgcggctctgatgaatcaggaggcggcagcaatgggggcgacaaggtcccattttgtcaatccgaacggccttccggatgagaaccattacacctgtgtctatgatatgtatctgattttttccaatgcgatcaaaaacgatacctttgtatccatcatcggcacaacctcctacgatgttacctataccgacgcttccggcgaggcagtgacccatacgtgggagaacaccaatcagtatctgaccgggaatgcaaccacaccggacggatttcagattgtgggcggtaagaccggaaccacgggcgaggcgggctactgtctggtactgtattcgtataatccatccggccagccgatcatatcgatcgtattcaaagcggacggtaagtccaatctctatcttttaatgaacgaaatgctgcagggattcgccatttagacggcggatccctgattgtttatatttatttgaaaattggttgtattttatgtgcatatagactataatcaatttataaaatcaactgcttttatacatattaacggattttgtgtagaaagcagcatcagcaggaggaaatgactatgatagagattatttcaggcgaaaagggaaaagggaagacaaaagagcttttgaccaaggtaaatgctgcggttgcctctgcatccggaagcattgtataccttgataagagtcagaagcatatgtacgaactcagcaacaagattcgtctcatcaatgttaccgattatccgatcgataattgtgatgagttcctcggatttatctgtggtattgtttcacaggatcatgatctggaagaaatgtatctggacagctttcttacgatcgcttccgtagagacggatgacgagatctgtcatgcaattcagaaactggatatcatcagtgaaaaatacaacgtaaaatttgttttaagcgtctccaggaacgaggcatctcttccggattgcgccaaagcaaaaattgtcatttccttataaaatgtaaaatgccgtaagaaaagtgctgtagcgatacagcactttttctttgccggcagggacttcttatgcctgatcgacagagcggatgcgcccgaacaggctgatcagatagagaccgccgagtccgacaagcgcatagatgatccgggagaaccatgacatattgccaaaaataaaggcaacgaggtcaaaacggaaaaatccgatcagtccccagttaatggctccgataatcaccagcgtaagcagtgtataatccaaccaatttgtattcattttctatgcctcctttttctatcatagtatggacatgctgcgccggttttattctgctttgccggacttgttgttcactccgggaacaaatcccgaatttattgccgctaaaaagttgttttccagggctgaaaatggtagaataaaaatgttgaatttgaaaaaaggtggggcattttttgagtaaaaataaaaaagtggttcgctatcgcaagccgtttaatgtcaatatcggaatgatcatttttattattatttttatctatctgatatttaacattttctcctacatgacgacggagcatatttccacgtatgaagtagagcagggcacgatggcagaaaataatatataccgtggactgattctccgccaggagcaggtctattcctcggatacggcgggggcgctgaatgtatatgtaaaggaagcttcccgggtgggttacggaaatctgatctgctccgtcgatgaaggtggcagtgtgtccaagaaaatcgaggaggcagccggcaacgcttccaatctgagtgcgcatgatctctcggagattgaggattccataagcgaatttcagatttcctacagcgcccagaatttttatagcgtttccacgtttaaggaagatcttgactctgcactgaatgaatccttgagccttgccgcgctggacggaatctctgattacgccgcggcggcgcaggcagaaaatacatttcacacctatcatgccgatcagcccggcattgtcgtctattccaccgacgggtatgagggcgttaccacggatacgtttcagtcgtccatgtttgacgaggcatcctacgaccgcacggacggtcagcgggcactgcaggttgcggcaggagcccctctgtataagctgattacaagtgaatactggtcgcttgtcattccaatcggctccgatctggcaaagcggctggcggacgatgataccttgcagctgcgttttatgaaggataacaccacgacctatgcgacctataccatcacggaaaaggaaggttccacctatctgattctgacgcttcgctcggggatggtgcgctatgccaaggatcgctatgccgaggtggagctgctgcttagtgaggagaccggacttaagatccccaattccgccatcacggagaaggaattctataccgttcccaaggatttcttcatgaaaggcggcgattccggcagtctgggcattctggtgcagaggagcgattcctccgggaaagcaggggcggagttcattgccccgaccatctactatgagacggataccgattattacatcgacggtgaggaggttggcgcttcggatatcatccgaaaggcggattctacggagacgtaccagatcggttccggcacggcgagcctgcagggcgtttataatatcaataagggatatgccatcttcaaacagatcgacattctctatcagaatgaggaatacgccatcgtgcggaccgggacaacctacggaattgcgctctatgaccatatagcgctcgacggaagcaaaattcacgaaaatgatctgatcaattaaacggaggaaatagatatgttaaaggaaaatttaaaaacagtggaagagcatgtacaggaggcttgtaagcgtgcaggtcgttcccgcgaggaagtgacgttgatcgctgtcagcaaaacaaaacctttggaaatgctgcatgaaatctacggggagggcgtccgcgatttcggagaaaataaagtgcaggaactgtgcgataaaatggagcagctcccgtccgacatccgctggcacatgatcggacatctgcagcgcaacaaggtcaaatatattgtcggaaaggttgccctgattcattcggttgatacataccggctggcagaagagatcaatatccaggcaaagaaacgcggcatcatcgtgccgattctggtggaagtcaatatcgccggcgaggagaccaaattcggcacaacggcagaagatgccatgctgcttgtggaagagatttccaaactggaaaatgtgcggatcaagggacttatgacgattgcgccgttcgttgaaaatccggaggataatcgcctttattttcggaaaataaagcaattatctgttgacataacaaataaaaacatagataatgtatctatggaaattctgtctatgggtatgacaggagattacgaggttgccattgaagaaggagcgacgatggtgcgtgtcggaaccggaattttcggtgcacgcaattacaaaaaaagcaatgaatcgcattaggagtataacatgagtgttttagataaatttttaaatgtcatgcgtcttaatccggacgatgacgacgatttttacaatgaagattatgattacgatgatgattatgaagaggatgaaccggtaaaatcgaagagttctttccgcaaggacaagaagaaggcggaggaggatgattatgaagaagatcattctatccacgagaaagccgtcaagagttctccgaaggtcacaccgattcgcccggtcaagaagcagggaggaagcggcatggaagtatgtgtcatcaaaccaacctcagtggaagatgcccgagagattacagagacgcttctcaataaccgcacggtcgtattgaacgttgagggactggacgtcgagatcgcacagcggattatcgactttacatcgggttcctgctttgcaatcagcggtaatcttcagaagatctccaactatatctttatcattacaccggcatcggttgacatttccggcgatttcttaagtctggtagacacgttccagtcgacacgcagtgtccagaccgatttttagagtctatgaacgaacaggatctttgtcagaagcgtctgcttgatctctccagacaggcggatcgcaagggaatcgttctattcagcgatttcctcaatttaaatgaattgaatatataccaccagtccgagaagctgtttgcgacgaggaccgaatgttttggcggtattccatgtgcagagcgtcagatgattgcctttcttcctgatgctctttattatgattgggaatatcccatttccgctttaaaaatcacaccggcttatcccaaatttgccgagaagcttggacatcgggacatcctcggatcgctgatgcagctgggcgttgaccgctgcaaattaggcgatattctggtcggggagcaggaagcctatctgctgtgtgaagagaccgttgcagactattttgcggagcatcttgaaaagatacgccacactctcgtaaaagtcgaaccgtgcagtctgtcagaccttaaggtgacacaggaattccagacacaggacggaatcgtaacctcagaccggattgacgccgtcgtcgcgtgcgtttaccatctgtcccgcagtcaggcgtcgcttttgctacgccaggagaaggtttttgtcagcggaaagctgatacagaatccatcctatacctgccatgcggatgatattatctctgtccgcggttacggacgctttatctaccgaggggaatacggaacaaccggaaaaggacggctcaaaatacattacgacctctatgcaaactgaaaggagtttttcatggcacaatcgattccagtaaaagcaaacgacagtatcatttatcatattgaactggttcatgatttttcaatgctccctacgtttctgcagcagctgggatacggacgcacacagaaaatctgcattgtgaccgattccaacgttgcgcctttgtatgcgagggacgtacaggatctgttggaaaaagagtttgacacggtcattcttcatacgtttgaagcaggagagcacaataaaaatctggagacggtaaacactttataccagactctgatcgagcagcattttgatcgtcaggatctgcttatcgctttgggcggcggtgtcgtcggagatcttaccggttttacggcggccacctacctgcgcggcattgattttatccaggtgccgaccacgctgctttcccaggtagacagcagcatcggcggaaagaccggcgtagactttatgcagtacaaaaatatggtgggcgccttttatcagcccaaactggtctatatgaacctgtccgtcttacagtccctgccatcccggcagattgtttccggaatgggagagattataaagcacggtcttatcaaagacgacgcttactatgaatggctgatggcacatcacgatgccattttggcactggagccagcagtcatggaagagatgatcgcccgaagctgtgatatcaagcgcgaagttgtagagcacgacccgacggagaagggagagcgtgcgctgttaaactttggtcataccatcggacatgccattgaaaaattgtgcggtttttccctgtatcacggagaatgtgtagggctcggaatccttgcggcggcgtatctttcccaaaaacaggggaacctgacaaaagagcagcttgccggcatcagtcagtgcctggctgcctttggatttcagacacagatcggggggatctcaccagatgctgtgttatctgccaccaaatccgataagaaaatggtcggaagccaggtcaaatttattctgctgcataccatcggagatgcttatatctaccgcgagttaagcgacgcacaaatcctggacggcattcgttatgtatgccgggcgtaatcccggcctgacagtgaaaacaacacggaaggacaaacctatctatgaaagatcattcacctattttgaaacgcaatctgaccggctgtgtggcggccgtgctcctcattctgctcgatcagtttaccaaaatgcttgcggtagcgcatttgaaggatcagccgtccaacgtactcatagacggcgtgtttgagctgcgctatctggagaaccgtggttccgcattcggaatgatgcagaataagctgattatcttgattcccgttaccgtcgtggtaacgttacttattctgtatctttttttcaaaaaacttcccgccacgagacactttttctggctcaatgcgattgccgtactgttttttgctggagccatcgggaatttcatcgaccgcgtcagacagggctatgtggtagattttttctatttcagcctgatcaattttccgatctttaatgttgcagatatttatgtgacagtagcggcatttttattgatctttttatgtctgttctattacaaagaagaagattttgaacagattttcccatcgggttcttccagacaacattcttcggagaaaaaagacaatgactagagaaacatttgaagcgggaattgcatatgagggagagcggctggacaagtatctgaatctcattttcagcgagacagatgcggcgcagtcgcgctccttttttcaaaaactgatcaaagaggggcatgtgcttgtcaatgatacggcgcagaaagccaactaccggttaaaggcagatgatatgatctgcgttgagattccggatgcggtacagacgccgattcttccggaaaatattccgcttgacattctctacgaggatgacgatcttttagtcgtcaacaagccgaagggaatggtcgtccacccgtccgccgggcattataccggcacgcttgtcaatgccatcatgtatcactgcagggacagtttgtccggcatcaacggggagatccgcccgggcatcgtacaccgcatcgatatggatacaacgggttcactgattgtatgcaaaaatgatgagagccatgtctttattgcggagcagatcaaggaacattccgtgaaccggcgctaccgcggcatcgtatacggtgtggtgaaagaggaagagggtaccgtcaatgcgccgatcggacgccatcccatcgagcgcaagaaaatggcgatcaatgagaaaaacggcaagcctgccatcacccattacaaggttctggaacgctttgagcggtacacatacatggagtttaaactggagaccgggcgcacccatcagatccgcgtgcacatggctagcattggtcatccgctgcttggcgacacgctgtattccagcggaagaagtccctataagctgcaggggcagacgcttcatgccatgacgatcggcttcattcatccgagaaccagagagtacatggaggttacggcgcctcttccagaatattttgaaaaaattctaaaagatttgcgataatttcaaaaaataattccgtttttcaaaaaaatgtattataatatattcatagaatgttaggaaaggcgggatcttttatgggcaacaaaatctataccattggtcgtgaatttggcagcgggggaagagaaatcggcgaaaagcttgcggaacgtcttggaattaagctctacgacaaagaattgttacagcaggcggcaaaggaaagcggtttctgtgaggagattttcgagaatcatgatgagaaaccgaccagcagctttttgtattccctggtcatggatacatattcgctgaacggctatcattcggcaccgtttctcgatatgcctttaaaccacaaagtgttcctggcgcagtttgacaccatcaaaaagattgcagagcgggaatcctgcgtgattgttggaagatgcgccgattacgcattatcagacaatccggactgcatcaatatctttattcatgcggacatggacaaacgcgttaagattatcagccaacgcgccaatattacggaaaacaaagccagggatctgatccagaaacaggataagcagcgtgcaagctattataactattatacgagcaaaaaatggggtgattcccagagctatcatctgacattggactccggtaaactgggaattgacggttgtattgatatgatcttaaagtttcgtgaaatcctcgatgcatccagataacatcatcggctaatatcatacaacgtgaacgaaatggtttcaaatggtttcaaatggtttcaaagaggcggcacttatttgatttaaggtgccgcctctttatgtctgcgcaaacaaacaccggcaaaatgcaggaaaaacgcacatattccttgaaatgcgggcggcagtgtgctatagtagagatacagatatttattcgcaaaacacaagtttaacgaatagtttctaccataaaacaaccataaagctgttttacgctgtgccggatgttttacgggttctgttttaacagatctcttcggaatccagcagaatggtaaacgggccgtcatttaacagagagatcttcatatccgcaccgaaaataccgcagccggtatctggaatctgttctttgcaccgtgcgacaatataatcatacatccggctcgccatttcgggcttcccggcacggacaaaggaaggacggtttcctttgcggcagtccgcatataaggtaaactgcgagatcagcaaaagacttccgccgacgtccgccaacgatagatttgtttttccgtccgcatcctcaaaaatacgaagccccaacagctttttgatcattttatcggcgattgcagtcgtatcggtatcggcaattccgatcagaaccagaaatcctttttgaattgcgccggtgacattgccgtctaccgtgcaggatgcctcggttacacgctgtattacaaatttcattttatcaatctcctttttgaattatttgcttcgttgatcctaaatttcatttcatgatagatcatttcatgacagataattttattataaaatagttacgaggtgatatgcaatctatggaattaaaaaaacttttaagctatacacgccaggcggttgacgattataaactcattgaggagggcgatcatattgcggtcggtatttccggcggcaaggactctctcactctcctctacgcgcttgccggactcagacgcttttatccgaagaaattcacactcacggcaatcaccgtcgatctgggatatgattcttttgatcttactcccataaatcagctctgcgaggaacttaaggtaccgtaccacattgtaaaaacagagattgcacgtatcctgtttcacggcgacagcgtgtcggacaaagcagtcaagggatctccgtgtgcgctgtgcgccaaaatgcgcaagggagcactcaatgaggcggctctggaattaggatgcaataaggttgcctacgcacatcacatggatgatgtgattgagacggcgtttctttccatgatttttgagggaagattctatgcgtttccaccgagcacacatttagaccgcacacagcttgtggtcatacgccccttactatacgtctctgaagcggaagtaaaaggatttcggaataagatgaagcttccggtcgtcgccaatccatgttctgcagacgggcacacacagcgtgcttacgtgaaaaatctgatccgacagatcaatctggatcatcccggagccaaaaaacagctttttcatgcagtattacatggaaatatccccggatggcagacagacgtcgctgaggaaaaggagaattcaattcgtttatgaaagaaaaagcatattatgaaaatgtgaatgtaaaaaatgaagtaaaattgcgcaagcttctggaacagcttccggatttctgcaaacagtttttcattggcattgagccaaccacttcctcgcgtaccagaatcgcgtatgcttacgatatcggctgtttttttgactatctctgcgatgtgaatcccatttgccagaactataccgtaaaggatattccgctctcgcttttagacgagctcacgcctatggatatcgaggaatatctctcctatctgaagtattacgaaaaaaacggtgtagagcacacgaacgacgagcgcggtatcaagcgaaagctggcctctctccgctccttttaccgctactatttcaaaaacgacctgataaaaaatgatccggctgtgaaagtggacatgcccaagattcacgacaaaaatattatccggctggatatcgatgaggtcgcgagactgttagacgaagtcgaatccggtgaaagtctgactccacgccagcaaaaatatcacgaccgcacaaagacaagagatctcgcccttatgacgctgctcctcggaaccggaatccgtgtctcggaatgtgtcggactcgatctggaagacgtggatatgcgcaataacggcatcaagattcaccgaaaaggcggcgcagaggttgttgtatactttggggaagaagtacgcgaagcacttctcgcttatatggttgagcgccagaaaataaccgccgaagacggcagtatcaacgccctctttctctccttgcagaaccggagaatcagcgtgcgttcggtcgaaaatctggtcaaaaaatatgcaaaactggtgaccagcttaaagcatattacaccgcacaaactgcgcagtacctacggcacctccctctatcgcgagacgggggatatctatctggtcgcggatgtactcggccataaggacgtcaacacgacgcggaagcattacgctgccatcgacgatgatcgacgacgcagcgcagccaaatatgtaaagctccgtgatgtctagtgttccccggagatgcatccatcgccttaagtcctatcagatccgtggctctggcaagactctgacaaacaaaaagctgtttataaaaaaagcagctcacaaagaagctccagtcatccgaccggagcttctgctggcttaagaacttcatctagcttttcctggatacgtaccttcaccagatccgcaatctcatgcgttttgagaccgccatattcatcgtataagatcggtttcagataatgtacctgcgtggtgaccgatcccaaacaaaagctgttaaaaactttataagaatcaatcagagccaccggtacgatcggtgcctttgtctttaacgcaatcttaaaactgccggctttaaaatcacacacatggttcttattgttaaattcgtatccgccctccggaaacagaatataacgctttccctgctttacttcctcggatacctcattgatgatcgtcaatgcctgtctgacatccttcttatccagccgctttccctgaagcagatccacaaattcacgaaccagtatggtattggacttcgccttatccatcacaagcgaacatggctccctgtgggtgtagataatgccgagtgcgtcgtactttccctgatgattcggatacatcatgtagccgccttctgtcggaagcagctctgtgccgtaagattttgtgtggatgccgccggttaccttcatcaggcgaatcacatggcgcgccagcgcgtagcgctcctctacactatacttttcaggatgatccgcctccctgcgcatcttcggtatcatataaggcgctctgaaaagattcattaaaatcacatagataaactttatcatacgagataactcatcctccgtaattcatattctctgtgctgccttcccgcacaatatgagctcgtcagaattcattataccgtacttacccaaaaaacacaaccgaccggagacgctgcacaaaaaataccatcttacttgagatgttctgccgaataatacgggatggtcagatactgtccggaatgaatgtcccccggcaggatgtgattgatcgcacagatctcctccatatattcgtccatgctgtcgtaatcgtctgtgatatattcatctgcgatattccagagggtatctcccttctggatctggatgcttgtgtaatatttataagaaggttctgcaggagccgcctgtgtgcggatcgttcccagcaggacagaaccgatcacaatgacggttaaaaccatcaatcccaacatgaatgtgcgtctctgcgcctttaccgctgctcttctgcttctcataagaatacctcctgtcatgttaatcgaacgttcattccgaacgtttgttgcgaacatttgtttatgttcctatcataataccagaacatccgtttgtcaacaagaaaatcgaacaaattttcggaatatatgtttgcatttttacgcatgctgtgttaaactaaattatacataatagcattggtaatgattgacaggaggtatatgcatggcatacggcaagatcagcacgaagcagagagagattctcgaatacattaaacaggagatattgaataagggatatccgcccgctgtgcgtgagatctgcgaggcagttgacttgaagtctacctcctccgtccactcccatctggagacacttgagaagaacggatacatccgccgcgacccgacgaagccgcgtgcgatcgagatcattgatgataactttaacctcaccagacgcgaggttgtcaatgtcccgattctcgggaatgtggctgccggtcagccgttactcgcagtcgagaacattgagacctacttcccgattccgaccgaatttctcccgaacgcggagacgttcatgttgagggtaaagggcgaaagcatgatcaacgtcggcatcttcgacggagacaatgtgctggttgagaagcagtcgaccgcgcgcaacggcgagatggtcgtcgcgctggtggaggattccgctacagttaagaccttttataaggaggacggttatatccgccttcagccggagaatgacacgatggatccgatcattgttccagattgccagattctcggaaaggtcattggtattttccgttttctttcctgatgaagttcggtattcctggaataaaatgcagattcctattataatgtacaagaaagaatcctgcttttcaggattctccgcctgcggcgggttgctctagcgacatcgcgcgagtgcacatccctgcggagcttttctatgtaacaggaacgaagtttcctattatatagaaaaaagtatgccccctttcctgtcagccagaagggaggcatactctttttacgacactcttaagttcaaaacacgcatctatgacctttccgtctctccggaatcttacggatccgccgcatctatgacctttccatttctccggaatcttacagatcagccacatctacgatctttccgtctctccagatacgctccagatcatagaataaacgatcttccttggaaaaaatatggacaatgatgtcaccgtaatccatgagaatccaggtagaactggaatttccctcgatctgtttggtcttaagtcccgctttgtataatgcctcttcgcaggcatcacgcattgcctgaatctgattctgattcgttccgtccgcaatcacaaaataatctgcaaccggtgaaatctcacggatatcaatgatcttaacatcctccgccttgcggtcttccaaagccgctactgctattttacaatattcctgtgatgtcattgcatgtttcctttctatctgttctttgttcgttttaacaggtaatccgtcaaaccggatctgtctgttccttctggtactgccggtagaattcataggcaagctgtgtggagggatctaacggtccgccgaccctggagcggtatttcaatgtgtcgcagagaatctccgccatacaggcatccagatcttcaaatgccagtttccgcaccctcggcagatctgcggccttgttccttcccggctcgatataatccgcaatatagatgatcttatcgagcgtactcatatccggcgcgccggttgtgtgcaccttgatggcgtgcaggatctcaggatcttttacttcatagaccgtctctgccagataagctcccagcttggcatgcagcagaaacgggctctcatattctacggcattgatgggaatgtcatgttcctcacagatctgaagcttctcatcgtccggaatacatttggcacaatcgtggagcagacctgcgagcatcgcctgctcgatcgatgtctcataagccatcgccatacatccggcggtatacatgacacctttcgtgtgctcataccgtcccttatccaactctttttttaatcgtttacgaatctcatgctgttccatttttattctcccaaattcgatacgccgtacagatgatagcgtttgatcagctcccacacctcgcccgggagcatggcgggacattcacctgtcatgcggatctgtgcgcggattgccgtcgaggagacatcggttcgtccgcccgcaagcggatagatctcagccggaaacaacgccttgatgcgccgtatttttccctcaatctgcggcagttctaaggtatccctgaccgctgcaagcacggtggcattctgacagatgatctccggatgcctccacttgtcaaagtagtccagggaatcggctcccatgataaagaagaattgatcctccgggaactgttcctttagatgctgcagcgtcttatacgtataacttgtcccggaagactctatttctatacgtgaaagcttaaatgacgcatcatttttgatggccgcctgcgtcatttccgcgcgcacctgcgcgggtgtcatctccgcctcctccttattcggagagtgccctgccggtatgaaccacacctcgtccaacgcgaactcccggtaggcgctccttgcaatattcagatgtccctgatgaatcggatcaaacgagccgcctaaaattccgatttttctcatgccggaagttcaaacttgctgtttttcttcgcctggcggaataagatgatcttcttgccgataacttttacaacagcagaatgtgtgcgctctgcgatgacctgtgcaatctcccgcggatcatccgcacaattctttaatacggaaatcttaatcagttcccgtttttctaatgcttcatccagcgcctggataatctccggtgtcaggcttgccttgccgatctgaaagattggatctaaggtgcttgcacatccgccgagataggcgcgctgcttacttgtcaattccatatcctgcttcctcctctttacttataataatcaaattcaaaaccgtacatgcgcacggtatcgccgtcctcaattccctgtgcctccatgtcttttaaaatgccctgctccttcatgaacttctggaagaaaaggaatcccttctcggaatccatattcgtatagccaagcatcttctcgatcttcggtccttccacaacgaatgcaccgtcgtcagccaccgtaatcgtgtatggctcatccttaaagaaacggagtgccggatcgaattcaggctcatagacaaccggctccttgctgcactggtcgagaagctcgctcacgcagtacaacagttcctttaatcccttgccgcttacggcagaaatcgggaacacacggattccgtctttttcaaaggtgtcttttaacttctggataatctcattctcgtccccgtagaccgcatccattttatttgccgcgatgacctgcggcttttttaacagtgccggatcgtaagcttccagctccttgttgatcgcgataatatctgccacaggatcacgtccctcggtgccggcagcgtccaccatgtggatcattaccttcgtgcgctcgatatggcgcagaaattcaagtccaagtccaacaccctcggaagcgccctcaatcagtccaggaatgtcagcaatgacgaaacccttcgcgccgtctaaatccaccacgccaagattgggctgcagcgttgtaaaatgatagttggcaattttcggctgtgcgttggtcacgcgcgataacagcgtggatttcccgacattcgggaagccgaccagaccgacgtccgcgattacttttaattccagcttgacttcaatctcgatcgaatctccgcccggctgcgcatattttggtgcctgcatcgtcgatgtcgcgtaatgctggttgccaagtccgcctctgccgccccgcagaatgacctgtctgcggttctctccggacatatcggcgatgaccttgccggactctgcatccttgatcacggttccctccggcacctttaagatgagatcctcaccgtttttgccgtggcagttgcgcttgccgccctcttctccgggctgtgccgcaaactttctgcgatgacggtaatccgtcagagtgtttaaaccttcatccaccacaaagatcacgtcgccgcccttgccgccgtcgccgccgtcaggaccgccatccggcacatatttttcacggcggaagctcacatgcccgtcgccgcctttccctgattttatgataattgttgctctgtctgcaaacattatattctacctcaattcaacttcaggcagcagatgctgccacctaccgaacggttacaaatccagatacaagaagacccggctatagacgcctgccatcaggtaagcgctgcatagtcgggtctacactctgcatcttattactcagctactggataaacagaagcctgcttcttgtcttttccttttctctcgaatcttaagataccatctgtcagtgcgaataatgtatcatcaccgccgatgcctacattaacgcccggatgaatctttgttccgcgctgtctgtataaaatgttgccagccttcacgaactgtccgtctgctctcttagcgcctaatctcttagactcagagtcacggccgttctttgtagaaccaactccctttttatgagcgaaaaactgaaggttcatattcatcatgttctacacctccctaaaattcagaatgatataatcattcccataagtattctgtattccctgcaggccaagtaccagcgactgcatcagcaatccggcatcgtgaccggccggtgaagtaaatcgcaggcgaatctcgccatcgtcttcgtcggcatccgtctcgcatggttcgtcggtaaacagcccgatggaattgatcgtattgataaccagtgcagaaattcccgcacatacaatatcctcgccttcatcggcatacccggcatgtcccaggcagtcgaagcccaaatactcaccgtcatgattgcggaaaatcgttatctttgtcataacaaccttccaggattaagcgttgatcttctcgatcttaacctgtgtaaacgcctgtctgtgaccgttcttcttgtgatagccggtctttctcttgtacttgtaaacaataactttcttggatcttccctcttttacaacggaagcctctacagatgcgtttgctacatcagaaccaaccttaattccgttgtcggatacagctaaaacctgatcaaaagttactttctcaccagcttctttaccaagcttttcaatggtaatgatatcgccttcggatactttgtactgtttaccacctgttgctataattgcgtacatatggcacctcctattatcattactcgccagttgtggtgtcgcccgggcaatccggacggactttgagacctcactgtgcggcatacttgattataatagcatagcagtttggtttcgtcaacagattttttgacttttttgccaaaattcttgactttttcctatggatcgtgctatactctcttcgctaaaacttggtgtggacttttcaagtctgactttttttcgccacacaatgattcttttgagtcattgtgtggcgttttctgttttatcctggatacaataaacccagactattatataggaggaaataccacatgaacgaaacatttatgaaagaaaaacctatcctgccgctgcttacctccatggcgcttccgatggtcatatccatgatggtaaacgcactttataatattgtagacagtctgttcgtcgccagaatcaatgagaatgccatgacagcgctgtccctcgtcttcccgattcagaattttgtcaacgcgcttgccatcggattcggcgttggtatcaatgcactgattgcctattttctcggagcaggcgacaaaaaaggcgccgaccgcgccgccacacagggacttgttctggcactcatccacggcgttgtcgtcactgtgttaagcatctccatcatgccggctttcctggacatgttcaccaacgatgtgcaggtatatcagatgggaatggagtacgcggtgatcgtatttgcgttttcgacaatcaccatggcgaatctttcctttgagaaaatctttcagtccgtgggacgcatgaaagtatccatgatcggcctgctgtgcggaagtattactaatattatcttagacccgctcctgattttcggcatcggaattttcccgaggcttggtatcgccggcgcagcgattgccacagcgatcggtcagctgtgtaccctccttctttacctgacggtgtacaacaagcgcccgatcccggtcaaaatccgcaaagaataccttgcttttcataaggaaaccgaccatcgtctctactcgatcggagttcctgccatcttaaatcttgccctgccatcgctgttagtatccgtcttaaacggtattctggcagcttactcccagatctatgtggtcattctgggaatctattacaaattacagaccttcctctatcttccggcaaacggcattgtccagggcatgcgtccgctgatcggctataattacggtgccggcgagcagaagcgcgtgaaaaagatctatgagattacgcttgcgatgagtgctgtcattatggcgctcggcacaattttatgcctggtggcatcgcgcggtctgatggaactgttcaccgaaaatgccgagacgatcgcagccggaggaaccgcactgcgcatcattagcgcaggctttatcatctcctccgtgtccgtcacagcctccggcgccttggagggacttggaaaaggaacgcagtcccttgtcatatcgctgttccgctatgtaattctcatgatcccggcagcctttgtattgtgccgtatctttggaccaaccggagtatggcatgctttctggatcaccgaagcagtcacctcggtcatcgccgcttatatctaccataaggcggtcggaagcagaaaataacatctgtcaaaagcatctgcgatgatccgtgtctttccaagtttggaacactccacggactgtgtccgcaagctaacagacaattttaggacttttgtgcgtgccccttgtgccaccactgagcaaaacataaccgcgcgaagccgatgtttgaattggcatctgccatgttttcaatagcagatgccaacgagtttcggttcgcgcggttttatattgtctgtgaagcggtggcactaggggcactaaaaagtccgctcattgtctgtggcttgtcggacacacaccgggagagtccaaacgtggaagagacacggaatcagatgcaaacctccgtcaggaagaaatgctctcatttttttcaaataattgtatcctatgcagttccagctgaaatctacatgctgtgttttctggcatattacttatcgcttcaaaattcactgccctctaaagtaccagcccctttttggacacttcctcctgaaagatcatgcgaagctgccctttcagcggaacattcagttccctcagggtgtcatccaatgcatctaacgtctcgatcatgtccaccacgttcgcattgctacccatgtgtccgatacggatcacctgccccgctagggagtcaaacgatcctgccagcatgataccgtgcttctgacgcatggtctgtaaaatggcatccgcggtcgtctctttcgggacgtcaaacaccgtgacggtattggagaaaccggatgcaaggtgtaagttcagtcccactgcgcggactgccgccctgcatgcctcaccgatccgtgcatgacgcgccagcatatccggatcgcccgcgatattgtcgaacgcggcgcgcagtccgtagatatcactgatcggcatggtgtacggaaaccattttttctcgtaatatccctcaaacaccttaaggtttgcataaaaagaggcaatcggtacacttctgccatcgatggctgcccatgccgcatcactcaccgtcacaaacgtcagtcccggaggcgccgaaacggctttctgggaaccgccgcagaggagatcaatctgaaaatcatccaggcgcacatcctcgccgaacatgccggagacggaatccaccaccgtgagtatcccgtattttttcagaagcggacaaagcgcagagatgtcatttaacatgccgctcggggtatcgcagtgcacgagcgttgcatatttgtaatcgtgatgttcctttaaatattcttccagggcggccggatcaatcggatttttctcatccacggaatacagaaccggctttccgccatacatggaaacgaaatcagcaaaccctctgccgtatacgccgttatccagcaccagtaccggatcgcccggttccgtcagggaggcacaggcagcctcaagccccagaattccctctccgcctaaaatcagggtctcattcccagtgtgcagcaggcggctgatcagttcacaggtctccttataaaaatctacgaaagtttcatccagatccggattggtgcagggaaaactgcgcgccatgcggacattctctttgacctgcgtaggtcccggtgtcataatcttatacatggaaacgcctccttagttccacagttttgcagctactttctttaacggtgcaatgatgataagaacgatcacagctgctgttccgatctgaagcaggttgcccggaatcgatgtcaccggtgtgatccagttgccgtaaataattccctctgcgatgtaatatccgccgatcttgatcgcgcaggcagcaagcattgccacaacataccactgaaagccctgcttcttctctgtaatccatcccatcacaaatcccatgcatccgacgatcacaaaggtaaacggtgcccatgccgtccagccggacaacagatcaaacagtcccatgccgactccgccggcaatggctcccgtctttttgccaaacaggattgcgaaaataaacagtgggacatttccaagatgaatcaatccgccctgcggtgcaaacggcagacgaatgttaatcagccaggtaaatacatataccagtgcgattccgatcgccgtgacggtgagaaaacgcacctgctctgtgctggttgtttttgtgctactcatagttttggtttctgacatgactctttctctctttcttttttgttagagccatgataccccatttctggatgaatgaatatgtccagttttactatttttgaccagtccagttcaactttcatctccggtgaatcccatatttctccggtattcgctcggcgaaacaccgcagcagcccttaaacagtttcataaagtgcttctcgttctcatagccgacggcctgggagatctccgcgatgcgcatatcggttcctgcgagcagccgctttgcctccttcatgcggatatctcttaagtaattgacaaaattacttccggtatactgcttaaacgaataagaaaacagggaataattcatggacagataattagagacaaccgccatattcagatcactggcatagtgttcttcaatgtaggcgaccgcctgcttcattttctgctgattcccgtttgtgtcaaactggcttaaaatctgcgcctgcagaccggtcacaaaggccagcaccttctgttcgtagcagtcgattgcatcctccccgaatgggtctgtaatctctttgatctccccgcagttttctttttcctccagcacattccggtacgtttttgacgtctccgtaaggaaatccgtcatgcactcctcaaagtcccggacaccgatgcggccatgctttacctcgtaaaaaaattgcgtccagacgtgctgcagttcctcggtgcggtcggttccaagtaactgcacccgctgcagtttcatctcgtctgcaaccagctttgacgcctcctgcaccagcttctgtgggacacgcggcatctcctgcccatagcgcatctgactgcggttcgtgcaaaacgcgcacctgcgcatttcccgcgcctccagatatgcctcgcgcagttcgcggattccctgatgcggccggctgattccggtatattcctgcaaaaaaggatattcccccggacggtccgaaagtgcttccgcctcgattaaaaagagatcattttcctcgacatcgcccaggaacaggcagtccttcgggcaggattcctcctcttttttccggttcctgcagcagaccacatacggctttccgctcagatctaaaataaaatgctggtcatactgggtctccaacatggtaagctcctcttccggcatctctgccagaagcatcagatgacggatctgctgctgtccgagcttctggcgcgttttctcctgctccctgccctcctcaatctcctgattcagcctggcaagtatgtcgcagattttttcgcgctcgatcggttttaacagatattcccgcaccccgttgtgcatcatcgccaccgcatagttaaagtcatcgtaaccgctgatcgcaacggtgagcggtatgtgttcacattcctgcatgcgctccaccagctcgattccgtccatctttggcatacggatatccgtaaacatgacatcgatggactgctcttttaaaatctcaagcgccgtctcaccgttgttacattccataatcacttccaccgggacaccgctccgctgaatcatcttgcggagtccctgccggatcagtttttcatcctcaacaatcaatacagtcttcattctgcttctcccctgtgcgtcatcggaatgcggacgataattttggtatagcatccgatctgcgacgccacttctatgccatacgccccgccaaatgcaatctggatccggtcctgcacgttttttaagccgattccgtttccggaacccccgctcgaatccagttcccctgcaatcttctgacgaagctgtgccatctcttcctcggtcatgccgcgcccggcatccgtaatttcaatcacgcagtcgtttccttccacgcgccccttgatgtagatgttggtatcttccgccatctgctcgattccgtgatagatggcattttccacgatcggctgcagcgacattttgggaatctcctgctgtaaaataatctccggcagattgagtgataaatagatctcgtaatcaaaccgcagattgattaacgccatataattcttgatatattccagttcctgctccaccaggacattgcctgatacccacttcatgctgtagcgtaagagcttcccgagggatgtgaccgcatccgaaatatcgtactcctcgtcgatctccgccatcatcttgatggactccaagacattatagataaaatgcgcgttaatctgattctgcagcgcacggatctctgaattttttaccagcatttcgcgctttagattgtcgtccatgagctgcttgatcctcgttaacatcttgttgatctgtgttcccagctctcccatctcatccggtccgcagtgctcgatcaccacgtccagatctccgccctgcacgcgccggatggcgcgcagaatctcgtacagctgttttaacagatgttttacgatcgcattgataaaaaatgtcagaacaaccaaaaacacgagcatgaccgccacaaacgtgttgcgcatgcggtatacgtgatgaatgttggacgtaatatttttcacgcagagcagggttccgtttaattcctgcaagggaaggtaggatacgatcagatgctgtccctgcagcttcagatagcaggtctgtatttcctcgtccgccgtatactgtgccatgatctcggcgagcagttcctgccgtcctgtgttttcgtcctccccgtcaccttctccaaaataacacccgccgtcctctgtcagaaaacagctccactcgtcctcaatgttctcgtagagactgggaaacatgttttccatcgtcatagccgcctcgatcattccgagcgtcccggaatcgctgtcctttatctccgtcacgagcgataagatcttgcggttctgtctcatcgtgtaagaattaaaaatctgatcgttaaagtcgtaatgccagccggtaacagtctcctccgactgccagggctgcttttccatgcgggaggctgcatagagaatcggcatcatctcctgtacccggtcgtttgacgcatacacacgcacgccgtagagaagcgggttgttgtttaccagacgctcgagggacacaatatcgctgttcttaaagctgtaccattcctccgccgaaaaagtctccccgtccttcgttcttttgagcatttccaaaagcggctcatcgctcaggaaaaactgtgtggacatgttgatggaattgatcttggttgcaacggcatctttgttgcgctccatggtgtactccatatatccggtattctccgatacgacgtttttctccatattgtaaaaaaggatgccggcaagaatgccgatgggaatcaccataaacagaataatcacaagggtaaactttacattcagtttctggctgacaaaccgttttttccaattcatgtaacactctccgtctctttactggatgccaagcttctctttggcgctgttcatatatgccgtcttcttctccatgacatccgtatagcccagctcatcccgcttctcaataaattcttcaaaaagggtgtcaaactcctcctccgatggtgccataagaagcgccggaagcgtctggctccagagctttgtaatcttgtcctcctccgatgcctccttggagccggagtcaaataccacatcatactgaccgttgtatacgacatattttcttccccattcctccagctgtgccgttgcaggcgatggttcctgtttccactgaagctgcatcacattgtcctgcagcatccagtaggcatcgtccgccccgtattccctgtcgtaagctgcgcggtccgtgtccagaatctgcttgatgttatcgcggagtaccggctttccgtcctttatatcgtaagtcacaccctcgacgcccagataggtgagaagctgcccgtgctcgctcatcagataatccagaaacgcaatcgcgcgctccgggtgtttgcagttcttggaaatcagcgtcaccgtccacccgttgatcgtggttgtcgggcgcagcggatcgtccccatttgcatttctcggaccttccaccgccatataaatgctgtccggatcattggcatataaaattttctgctgtgtcagcatatccgaatattgatacagcatgcagaagtagcggccctgcgccactttttcctccatctgtgtccgggtgtccacaaaaatatcattcgcaagataaccttcctctcccagctgtctgaatactttcagccagcgaaaatattccggatcggtatagcggtcatagtagacgccgtctttctcccacggaatggcaagaaaattcatcaggtatttgtcaaaggagacatttccctcgttgtcgaacacgtgcgcaccgatcgggatcagaggctccccgtctacttccggaaacatctccgctgccttctttaccgctgcgcaaaagccttccggtgttgtcatatccgggcttccgatcgcctcgtagatatccttgcgcaccagaaaggtctgattgctgcttaaatcctcgcactgctctacatcctgcggcgtgatggaggagttcgggtaggcgtaaatattgccgtcgtccgtggtataccagttcacggccaccgggtccgagacctcccagaaatacggatcatagctgtccgcaagctcattgagcgcatagaccatgccgttttctgtcatctcgctcacctgcggttcccaccatccgagcgtgattaaatccggcagcgagtcggacgcaatcagggcgttcagtttctcggattcatttccgagcggcgtgataaaatgaatatccacgcccgtctcctccgtgatcgtctgcgacaccaggttctcgccccacggcgtcgaaaaccaggagtagttgatataccagtccagcgtcaccggatcgtctgcgtacgtctgccatgccggaagatccccgtccggctgcacttgtccggctgcttccgtttccggcacatttccggaagcgccggtcataacattcccgcaggcaccgcacagcgccgctgttataagagaaaaaagcgtcacacacgcccattgttttttatatttgccacccattccaatcccccgtttttctccgtaaaatcaaagattttcctgtctctatcatataatattttccggcatatttccagcaggaaaagccgttttcccatctcccctgtactagcgtaaagcacgcaaagaagcactttccgtttccggaaagtgcctctttttaagaggagaactatgaaaataaagttttgaaacctgctggcagtttattctttgacgctgcccgccgaaatactgctgataatgtatttcgagcagaaacagaacacaatcaggatcggtatgacagagattgccaccgccagataaatagcgccctgatttctctgaatgtccgtcgatgcttttaacgtcgccatcatgaccggcaatgtaaacttctcatttttgtttaagataatcatcggaagcagataattgttccagtttccgataaatgccatgatcgccatcgtcgcaataccaggagacatgatcggaagcgcaatcctgtggaaggaatataattcgcttgcaccgtcgattctggctgcctccaccagtgccggcggcatcaccgataaaatgtactgtcttaagaaaaacaccgttccgggtgccgcaaccgccggcacaatcagcgggatataggaatttaccagttttaatttggtacataaattgtaaaaaccgatcaggctgagctgtcccggaatcatcataaacacaaggatcgccgtaaagatcagcttgttgccgcggaatcgatacattgccagtccatatgccgtcatcgccgagaaatacgccgtcagcagtgtggcaggaactgcaaccagtaagctgtttgccattccgcggaacagattaaagaaactaaatacggtctcccagttttctttcagatgcgtgctcggtatcagcgtaaagaaatgtgtaatctccacaccgtccctggtcgcgttgaccatcatcagaagaaacgggaacaggcacgccgccgcaagcaggacaagcagaatataaataacgctcttttttatcttatcacccgtcgtcataactaatcctccttgttgactaattttaactgcagcacagatacaatcagaatgattaagaacaatgcatatgcaatggcagatgcatatccggtctgtgttgtgcctgtcgagaaaccaaatttatacagatacattaccacggtctcaattgagttgtaggatgccgccgtcttctccgacataaggaacggcaggtcaaacatctgcagtcctccgatcaaggaagtgattgccacgtaaagcatgatcggctttaacagcggcagcgtgatttttccaaatgtcgtccagcgccctgccccgtcaatcgctgcggcttcaaagtaatctttgttgattccctgcacgcctgccatcagcataatgaaggagttgccaaaccacatccatgcactgatgactgcgatgacgcttcctgcggtgccggaatttccaagccagtctaccggcgccttgttcactccgaagaactgatagacggaatttaagatctggttaaacgtaccgtatctccagtctaacagtgtcttaaagagaaaagcgacagaggtggctgcgatcaggttcggcagataatacagtgcccgaaacaccggcagccccttaaatttatatttaatatcactgaacacaacggtcagcaaaaatgcgagtcctaactgtagtacgatattaacgccccagatcctgattgtattccagagcgctctccagaaaaacttatcggtaaatacgcgtgtataatttttcagaccgacaaaatggtacggcattcctgccagcttgctgtcggtaaagcttaaaacgagtgtgcggaataccgggtacacactgaaaatcaggaaaacgatcacaaagggagccacgaaaaagtagcctgcccggttatactttgtgaggtttgatgtcttttttttcggatttgtttttgccataggaaatcccctctatctcattttgtattccccctccggcaccgccacaacatcctttggggacattgtggctgccgtccgggaggataccaagttaccctgctcttatctgtttactgtgatatcaggatatgtagattcaatcgtgtcatagaaatcattcactgcctcttccttggtcatctgtcctgtcttgaccgcagagatcgcattgccccatgcatcaccgattgcctgatcgtaacgggttaccttggaggtatcaatctccttcgcctgctctaaccagaactggtacagtttctcaccgccgtagattgcattttcatcatctttgtgcttctcaagcgcggatttcagagaaacggtatcgccctgggagaaatcgatccaccagtctgcggtgtcttcatttaatgtacagaattttacaaactcccatgcggtatctttgcggttggactgggaggaaataccgatataggtaccaccgtcaaatccggaggaaggtcccttgcagacgccccacaaaccggaggtgtcgccgacattatctctcatggtaagtacgccccaggacggcagtccgaacgcgaagaccgtcgtggtgtccatgcccttggttgcctctgcaaactctgttgcatcccatacgttgacagaatcatccgcgtaattctggatatctgcggttaagatcggaacctctcccgccattgcctgataccacggcgtggaccactggttggcatatgcggtgagatccttctgatacagatccacacaaagatccatgtaatcaaatcttgcctggtctacatttaagacaccgtcaaccacccatgcggaatcaccggaaaatacgcccatctctgcgtctgaggagaaaatacggtatcccgcgtccttcaacttctgcgcggtatccagaatagtcgggtaatccttaaataatttgccgacctcatccggatcatccgttccgaatacttccttggcaatatctcttctgtaatagatacctgccggggtgatctgataggaaatggctctctggatgccctcggaatcctgtccgactttccatacataatcaacgatctgatctgcatagtcctgtgcgttgtacggtgcctgattcagatcctcaaaaaatcctgcgtcgtaaaaatcctccagcatcttcggctcgcctacgataatatccggttcgctctcgccgcccaaaagcgctgtctgcaccttggtcggatagtttgcaggctcaatgacaaccgtgtcaacggcaactccggtctgctcttcaaagcgctcaccaaagtcgatcaggtcatttgagagtgtccataccaccagcttatcatcgccggaagcggacgtgcctgcaccctccgtagattctgcggtacttcccccaccagaagctgcatctgtgcttgtttctcccgaatcgccgcatgcggtcattgataatgccataatgccaacgagcatgacggatactgcttttttccaattcataaaaatatcctccttttatttcaacatctctgttgttttgatacttgcattatagatgctttcatttcctcaaaaaatgatccaaattttaaaaaggtatcatttttttagtccacggcaacctccatttttctgacccttccggcgcggatatcctccgccagttttccggagactttctccccctcaacggtcgcctgactgccattttcatagaaaaacaccatatggcggatccggtaggttcccggcacataatccctgtgcccgccaaattcatagcacacggtcgtcttgctcataaacgcagcggaaagtctgccatcctccggaatcagatacgccggaatggccggtgcaagcgaaaagaccagttcctcctgctccgtccggaaaggatgtgcgccgaacatcatctctttccacatgctgataaattcgatcgttgatccgctgagtcttgccacgaatcctcttccgcggcaggacggattcggattcctgctgctggctataaacgaggaattttcgtaaatgcttcttccgtaaatctccgggttctggaacggtatcgcagccttcttgaaatccgcgaaaaattcttcatagagaccgctgcgcagaagttcaagaagatatttatattccatatgaagccagatggattcgttttcgagccagcccggggtaaatgcacgcgcacgcccaagttcaaaagaggaatccgcaagggaagcattcaccttgtacatggacagttccccgtcgtagagatcgctctctttgaccgcttcgtacagggcacgcttctcgccctgctccacaggcagcttcagatagcgcaccggtccctccagaaaatacggcatattttggggaacaaattttaacgggcggatgccgccgtcctttaacttttcatactccggcacctcgtaagtaaaatacgtcgggcagatctccccggagatccggcgcgcctttttgattccgcaggtaacaatctccaagaatccttccagaatcgccgcaagctgctccgtgtgatagaccatcttcttaccggatacgccctgataggtcttgtcgcggtaaatctccttcgcgtcattgatccggttccagaaggacaacagttcctcgtcccgcatgatattgtcgtgctccagccgcgtgatcagattcagttcatccaggaaacatcccagttcctctatgagtgcgacttctcccggatattgctttaaggcctctatggtgtaggagagcatgcgcgccagctcgtaggtctccgccatggaagaaccgaaaagtcccggcataccgtttagggcgtcataccatccgggctttccgccctccatctcgattcccattccgtaagcatccagcgtggcaaatttcacagcaccgagcagtatcaatttctccatcagcgtcatggtcagcacatccccgctgccgtattcggttctcaccagtttttcccccaagtccgcccgcctggacgcctcgtttaacgcccggtactgccttaagccattctccgtctccacatagcggcggaacctgcggttcacattgattctggacaaaaaggtggtatagacctcctcatagagcatttccttctcctgctccgggaacacggaaaggtaatccagaatcagatcgagattgtaggtccagtgatcgctccagtagccttccccgaacgatccgttcaccatctcctccgcaaaatcaatgacccggataaataacgtctcatcccaggtatcgccgaatacctccccgaacttccggcagagtgctccaggcgtaaacggctttgtcacgaagtcaatcagcgcgcttctttgctcctccttcacgtctgtcaacagcttctttgcccgctcctttgaaaggcggtaggtcagtttctcgacgccaagcggattgtacccgtccagctggatcagactgtagaattcctgtatattctttctgccgacgaacggtgcaaaaaaggtgtcgcagcggcggttctgattgacatcgcggaagttcccgtttccctgcgaatagaattccggcagcatggaaaagtaattgtaatcccgctccagatcaccgtgttttctggaatagacataaaagatcttattgttccccagctgcatcggataaccgccgcgcagcacattgtccatataagtgtacctgcagtaggcatcgaacgccgcggaagctgtcctggtgcagataccgtctgtcagcgcctctgcaagttcatcagcttctctttttttcgcctcaaaataggcggcatctttcttttccgcaaaatattcctttaaaagctgcttgttctccacctgtccgatcagttcatataaggtgacgcttccgcccggggcaagggtgcgcgtgatgccgtaaaagctgcacggcagcaggttctgcgtcatctgttcttccagaagaagttcctttaacgggcgttcttcaaaaccgaccggtcttttcagcgacagatcataggaaaaaaccaaagacggatccacgatcggttgcaaccgtctgccatccgcttcgcagcatgccgagaaattgccgccgtcgatcctgcgcaccgccgcggtgtcatccatgcttgcccgcacgcggtagtacggcagaccctcgtttaaatcctcgacctgcatccacgctttcgcggtctgccccatatttttcatgctgtccatggacacgccgtacggaatcaccgccggcatgccgtcaagcagttccagctcgatgggctccccggactgattggtgacactcaccacgcgcacaagcgcgccgacattttctccgggcagtgtatagtacaccacttttgtgtccattccacttgaccggttctgctcctcgattgcaagaccattcatgtgaatctgcatccgttgcgtgatgttctcatccgaaaacggttcaaaaaccgtaccgttcttctttaaaaatgtgcggaaccctgtggtctttacattctgatatgcctgatgcgccggataaaattccatgatcgcatgatctttattgtccacgccgaaactcaccacacactgtccgcgattcacatagtagcaccagatcgggattccccgtattcctgcaattcccggcagaaaactcgcaaatgtggattttttcccataatcattcattacaaacgtctcatttttccctgtcatctcattctcctttacaccagttccaccaaaatttcatgcgtgacatcaaaatccagctgctttaaccgctccctgtcgatgcagacactgcgcgtctctttctctcccccggaataatcccacaattccccgtcaatccggatcgttcccgggcggtaagcgccgtactccttgtgctctttgttctcgtagaccagatgcagcgactgtcccgcaaacgaaaagaaaagctccgctctttcatccagatcaaactgttgccgctccagcttcggttccaacatcagattgccggcacatcccttcgcgccgaacatttccgtaatcacggtaagcatgtaccagcttgccgcccccgtcagataatggtacattccctttccgcggctgttaaaatactccgggattcccggataaatccggctggtttcaaaatggacagactgacggtaaagcgcatccaatgcccggtgcccttcctttacaaatccccgcttatagagggcgtttgcaaacatcaccgccatgtgtgaaaagaccgcaccgttttccttttccccgtaagcgaacccgaacattcttcccagatccattttcacttcaccgaaatccgtatttaaccggtaaccgcccatcgcgtcgcagtacagatatttgtctgcgctgcggacaatctctgccacctgttcatccgtcgcggtctgtgccataacggcaaacacctgactggtcagcatcatgcgcacgccctgcgcaaagacaccctccacgcacctgccatgattgtcatagtatccgttaaaccagccgtttccctcctcatcggtcacccactctgtggcacggatatgtccggtcagaaaggctgctttcttctgcaggctgcggacaagctctgtaatcgaaacctctgtcttctgcccgcttacttcatggatgcatgcatcggtatagcgcgttaagagttcctgctttttttgaaccgatgcatacagggtgtcgtcatccgcaagcagcacgaaaagatcccgatttaacggcacagactccttcccggttttctctgcgtagagtgcaagcagctccgcgagttcccggagattgcctgcataggcgttggtaaatgcaacgctctccccgcgctcgcccgccatatccagcgcatcgttccagtccgcgccgcgaaggcggatatgtccgtgttcgcccacctcgtagaaagccgtcagattctgcagcagaagatgctccagcacgcttccgcggtagacatttcccgcggcatccctctgccagcagccgtcctgcgccttccatgccgcatccttctttgtcccgcgccctgcctgctgatccttaaaatatgggatctcttcctccagaaccgcaagatcgccggtctggtcgatatagagctttgtcgtcacaaacggccagaccccgtgatccatccacacgcgcgtaatctgattgcggtcggcgataaaggttccctccttgcttccgataatggtcgcattggttccgtcgatgcggacaccctgaaaattattgagaagcatctcgcgcacaccgtccggattcatcaaaagaagtgccagacagtcctgccagagatctctccagcctcttcctccctttccgtaatcatggtgcggcaaaaaggaacagccatagatccggcgcaggatcggctgaaagctgacccactgcatatagcggtcaaactggcggtctttcgtgtggtaggatacatttactttctgttcccagtatgttttcatgcgctcatacgccgccttcgtctgcgccgccgtgcggtacgctgccgtcatgcttaaaatcgtctccccggcatattccgtctttcgcaccgccccgatcatgatcgtgtatcctgcggtctcgcccggtgcaagaatcctctccttaaaatggagtccgccgaccgcctcacatccggcatatgcactgcccgccggcacaccggcaagatttttgacaaccgcctttggccgctcaaaattacctccctcgccgataaaatcctgcacggtcgggtaaaaatcttccggtgcctcccccgtctggtcgtatccgcacacaaagtaggtcatctcgttcgggcggtgcccccgctcgtcaaaagacatcgtcggcgtcacaagcacaccgttctccaccgtgcggatgcggtgcagcagcgatgtcacatgccggtgatccctcagattgtccgcgctcctgccatagaccggtatggctgcggtcggcgtgaatcgtacctgcatgttgcctgtattggtaatctccacatacatgatctccatcggatcgtccagcggaacaaacgacgtgatctgtgccgaaagctgatacttcctggaggttctcgtcacggtctgccacataaaaccggctgtcacttcgttttcatccgcaagatccgtaaatttttttgcgatttcttccgccgaattgcccgtggcggaccagcttccgtgcgttccgatatggcaccagaaatttctggcattccgattattatgaagattctccacgctcaccggctccagcagaaacgtattctgatccagcttgcagtccccgccaagtgtcggcgtcaccgcgcttttgataccacactcccctgcgaccgggaaatacagatcactgtaatctgccgcccccggcagagaaaaaactcccttatcactgataaattgatatgtattctgcatcctgcaagtttcctttcatttttttattattctaaggaaaaaaacaggcacaaaaaaagataccttttttttgaaaggtatcttttttttagaatcccagaccgtccggaaaaatctcatgcagcggtctttttatttttttgcgggtcacctcgaccagaccgagtgcggtcatatcgataagctgcgccggaaccggatctttttgcagtgccgcccggaatgtcttaagcagttcctcttccgcggattttgatgtcagatttataaaatccaccagaaccattcccgagagattccgcagccgcagttgtctggcaatctcctctgccgcttccttgttcacgcgcagaaagttctcctgcatctccttttttgccacattctttccggtgttgacatccaccaccgtcagagcctccgtcggctgaatgaccagataggcaccggattttaaccatacgcgctcactcaatgcatttttcagctccgaccggacactgtagagtgctccaagggagagcgccggatccttgtaataacggatccggattccatccgccgtcattacatcgtccaccggcacgggcacgcttcctcccgtcgtaagcgcctgcttatggatccggcaggcactgcagatatcctcgaacattccgcggtcatctgtcacaatctcttccagatcgtccttccgcaggtctctgatatggcgcagccatcccgcttcctccctgtatacaagcgtgtaacagttcttgtgtgccgccgcctccgccatcgtctcatagcgctccgaaagcacttccagttcaagcagaaccgtctcatcggaagcctctgcggcattggtgcggagaatcacgccgtactcccctgccgtctgctctacaagcttcaccagacgctctctggcctccccctttacctttgatgagacgctcttcttccggtttccggaagttaagacggcataggttcccgcgatcgtcaggtttgtcgtcaccgcgggatcttttgtcttaagcgcctcgcgcgagacctgtaccagaagttcatcgcccgccgcaagcgcctttgtctgcgacagctttctggtaaaaacgggattcttcacatcggacagcggcagatagcaccgtatatccggcgctatcttgacaaacgcggcatttagattggtgacaatgttctcgacttttccgacatagatattgccgagcagtgatgtctcccccgccgcctccggcaatacctcaatcatatgttttttctcatcataaagggcagaaatcagatattcctgcccttttatcttctctcgcgttatcatgtaacggttcattcgattacttctcccatcgcgcctaaggacacaaaatcatccccgtcggacgcatagacatccttcctgtgaatctgaatcgcattgggatcataggtaagtcccatgtgtaaaaacagcgcctcaagcaccagctccggcttcagattatccgtacttccggtggaaagcttcagatagaaggacggcacgccgccgcggtccgtcacctgaaagccgtagatgagcggtttgatatccagcacgcgctcgctctttttcgtctgcttggtgatgagaacctcatccggtttctcaaagaaatcgcggataccgtcagcaaacgccgaaacagaaaccggtgccgcatacccttccttaaaatacagatcataatctgcggcggcaacgatcgacattgccgtctttgcctgatccggaagtttcacataaccggtgcactccacgccctccaccatgacgccgtttaacgcccggagggattcctccgtggatgcactcgtgtgcacttcaatgtccatatactcgccgtcgctcgtaatgcccacgccgagcggcgcagcaaacgacatgatctggtgcggggaaaatccctccgaatagcagatgtcaatgtgtgctctgcgcattgccttctggaagtaccgcatcacatcgagatgtccgataaacttcatcacaccgtacttgcggaaacggattctaattttcatagcagacacctcctccgaacttcttcacaccgcagcccgaacagcgcatccggcagttcggcgtcacggtctctttcatggcattgttccactcacgctttaaaaattccttggtcacgccggtatcgataaaatcccatgggaaaatctcgtccatggaacgctcgcgcatcgtgtaaaaatcgggatcaatgccgcactccgcaaaggcgtccagccatctctgatagtcaaaatattcggaccatgcatcaaaaatgccacccttttcataaacctttaagatagcctgtccgattttccggtcgccgcgcgccaatacgccctctaagaccgtcacatccgcctcatgccagttgtatttaatgctctttttgtttaactgttccttgaccgtgtcgttgaccacttttgcacgtccgatgtaatcctccggcgggtacattcttgcccactggaacggtgtaaacggcttcgggacgaaaaaggaggtactgatcgtgatctggcatctgccgttccgcttctccttgggaacggtgtcataatagcgtgccgccgtctcattggcaagctccgcgatcgcccgcatatccgcctctgtctcggtcggaagtcccagcataaagtagaacttgaccttattccagccgccctcaaacgccatctgggcgccgtttaagatgacctcctccgtcagtcccttgttgatgacgtcgcgcaggcgctgtgatcccgcctccggtgcgaatgtcaggctgctctttttgatgtcctgcaccttgctcatgacatccagtgaaaacgcatcgatgcggagcgacggaagcgaaatattcaccctgcgctccctgcactcgtcgatcaggaaattgacaagttcctccagagagctgtagtccgatgaacttaaggagctgagtgagatctcctcatacccggtcgcctcaatcatctgtgtggcaagcgcctttaggcgctcaatatttttctcgcgcaccggacggtacaccattcccgcctggcagaaacggcagccgcggatacagccgcgctgaatctcaagcacaacgcgatcctgcgtggctttgataaacggtacgaccggcttttccggatagaccgcatccgtcatatccatcacgagctgcttggtcacagtcgccgggatttcctcatccaccggtgtaaacgacgcgatcgttccgtcttctttatattccacctgatacagggaaggcacatagattcccggaatctttgccgcctcatgcaaaaactccctgcggcttctgcccgcccgcttcatctcctgatagagatctaacatgcggtcatatacgacctccccttctcccatataaaacagatcgaaaaagtctgcaattggttccggattgtaggtgcagggaccgccgccgatcacgatcggaacggtatcgtcacggtctgcggcaagcagcggaatctggcttaagtcaagaatctggagaatattggtataacacatctcatactggatggtaattccaagaaaatccatattcttcaccggctcctgtgattccaggcaaaacagcgggatgttctcctccttcatgatcttgtgcagatccggccacggggaatacacgcgctcacaccacacatcgtctctcttattaaacatatcatagagaatctggatgcccagatgggacataccgatctcatatacatccggaaagcacatggcaaaacgaatcgatacctcgtctttgtttttacagacgctgttcaactcgtttccaatgtagcgcgccggcttatcaatcttcatcagtatctcatcggataacgctaactttgtcatttcttttatcctttcattctgtatgcagaagttctgcaagcactgcgtcgcactcctgcaaaattgtatcataccgattatcttcgatcatgtcaatcattttcgccggagtgacgccgcaaaccgtatttccactgtcatcccatgcaaaaaagaacaaaaacagcagcagtgccacaagaaagcggagctgtccccccgcgcgccctctctgtggctcctctctgtcaaaaggctctcccgcatccgctaccgtctcaaaggaactgcggacctgtgagacatacgctctccgccgttctacatagtctgtcatactgcacctctcctatcccgcctgtgctctaggatactatatgagatttttgggaaaaacatgtgcgcagaacatcgatcagttttgaaaccgcaaacgtcaaaaaacggatgatggtctgatccaaaatgacggctcccacaaatgacagtgcaaacgtgagaagtacggcaagcagacagcctcccacgatgccgccggacaggacattgacgtgaagcacctgcttgacggcatagtggagcacgccccagtgaatcagcagaatcgaataactgtacttcccgatgacgcgcacaaaggggctctctttgctgccgcagggcaccagccgctttatgagcacaaacacggcggcggcataaaacatcatcgtaggcgcattgttgtaaatatagtcgtcataccagccatggaacagaatcacatagcaggtgatcagatatgacacaagacccgccgcaaggaaaaaattctctgcccgcttccccgcgcggttcgcgagataatagccaagcagaaacgcccccgcatacgaattcacaataccggagagtaccgcaggcggcgtaacgccaaacagtggcacataggtgacatacgcattcagaaggaagatcacaagcatcacgccgttcatgaccggatcgggaatgttctgcaccagataccgcaaaaacggggtgagcacatacagccagataatgacatagaccagccacagatgcggcgcttccaccggcggtccgatgaagaaccgctgcagcatcagtccccactgcgacggagcgagccgtccgattccctctttggcacagacatacagattgtaatagaccacgagtgggatgaagacacggataaaacggcgcgcaaaaaaatccctgcaccgctctccttttaccggcagcagcaatgcgccgctgatcatgacaaagaacaggttgcaggacaaaaacgtataattaaagacttccaatacgcgaaaaagcagcgtccccggcgctgctgtcgtcttcgcgagcgcgacggtgtggacacagatcacaaacaccgtcgcaatcacgcgcagaacatccatataaacctttcgcggcggctttaccgctgggaaagttcctgtgtgatatcctcccatgtgactcctctttctgccataagcaccatcatgtgatacaggaaatccgagatctcgtattttacctcttccggatccggattctttgccgcaatcacaatctcggtcgcctcctcgccgactttctttaagatcttatcgattcccttgtcaaacaggtaattcgtgtaagatccctccttcgggtgtgccttgcggtcgagaataatctcatagacatcctcgagtaccttaagcggattcttctccacatattccttcttgacaatctcgttgaaaaagcaggtcggattgccggtatggcacgctgctcccacctgggataccttcgcgaggattgtgtcataatcgcagtctgccgtcaaagacttcacatactggatgtggccggaggtcatgcctttcgtccagagttcctgacggctccggctgaaataggtcatcttaccgatattgattgtggtataaaaagcttcctcgttcatgtaggcaagcattaacacctcatctgtacggtaatcctgcacgatcacgggaaccatgccttctgaattctttttcagatcatcccactttaacgccgggtcaaaattgtccatcttgatgcccgcggaagaaagctgtgacttgatctccatgatgttggtattcggatcgtttaagaaaccgccggcaattccgcgcgtgttgctccgctttaacacctcaatgatcttctcgtaatcgcaggtctcaaaatagaccacatacggaacatccgtaatattctcaattgcatccagaacaccggtgtttaacaccagaagttcatggaaattctcattcatcttcgcctgatgtttgaacacgaagtccacattctccaccgacacgaggatccggtcttttccgaaacgcttgctcgcctcctcggcaagctcgatgctgttcgccttggcgccgttgacaatgacctgaaggcatccggcatagataaactttttgatgtcctcgaggcggttgatgttgccgcccgcgcaggtcttgatctccacgttacggttgatgttcttgatcgtgtgaatattcttctcatgctcctcatcatcgtcagagagatcaaaaatgataatcttgtcaattccgttgtcattgtaaagctttgccagctcgatgacgtccgccagcggggtgtgatcctcaatcccccgtaccgcctgtccgttctttaagtaaatcgttgcaacgatatttttctgttccataaaaatataatacctttctataaactgcccttcgtagacaaaatatccgtaatccgcggatcataagatgtcgcctcgtcgagggctcgcgcaaatgccttaaacatcgcctcaatcatgtgatggttattgcccggcgtcagcaccttgatgtgcagattcatccctgccgtgtaggagatcgcatagaagaactccttcaccatctccgtgtccatgtatccgactctctctacggtaaaattaccgtcgaaggacagatacggccgtccggagagatctaccgcgcataaaacgagtgtctcgtccatcggcagaatacagcttccgtaacgcttgatgccctttttgtccccgaccgcctttttgatcgcattgccgagcacaattccggtatcttcgatcgtgtgatgacaatccacgatcagatcgccctccgccttgaccgacagatcgaaaaaaccgtgtctggcaaagccctcgagcatgtgatcgaaaaagccgatcccggtatcgatctcgcttactccgctcccgtccagttccagactgagcgtgatgtctgtctccttggtctttcgcacataatctgctgttctgctcatactgactcccgttccttcccaacacttcaacttttattatattacggtttccacgaaaaaggaattacttttgttcagaattttcctcaaaccggacacggattgaattggcgtgtgccgtgagtttttcgcactccgcgaactggatgatgtccttgtatacattctcaagcgcctccctggaataggaaatgatgctggatttcttgataaaatcatccacgccaagcgccgagaagaacttcgccgtaccgttggtcggaagcacatgattcggtcccgcaaagtagtcgccgagcggctcggaggaatattcgccgataaagattgctccggcgttgcggatcttcgtcatcacctcaaacggattcttcgtcacaagttccaggtgctcggacgcaatctcattgaccgttgcaatcgcatcgtccagactgtcggcaaccagaatgtatccgtaattctccagcgattttgtgatgatctcctttctcgacagcttctccacaaagcggtcgatctcagccgccacctgcccggcaagcgtgcggcttgtggtaatcagaatagcggaagccatctcgtcatgctccgcctgcgacagcaggtccgccgccacataacgcggattcgctgtctcgtccgcaaggacaaggatctcgctcggccccgcgatggagtcgatgctgacataaccgaacacagccttttttgcaagtgccacatagatatttcctgggcctacaatcttgtccaccttcgggatgctctcggttccgaacgccatcgcagcgatcgcctgcgcgccgcccaccttatagatggcgtccacgcccgcctcctttgccgccacgagtgtggacggatagactttcccgtctgctcccggcggtgtcgtcataatgatctgctccacacccgccacttttgccggaatgacattcatgagcaccgacgacgggtagacggccttgccgcccggcacatacacgccgactctcgcaagcggagtcaccttctgtcctaagataatgccggattcctgtgaatcaaaccaggaattctggcgctgtctgctgtgatagtctcggatattgacaagtgccttgcggatcacggagaggagctttggatctaccttctcgtaggcttccctgatctcctcctccgtgacaaggatatttccggcatcaatgtcggcaccgtcaaactttttcgtgtaggaaaaaacagccgcgtcgcggttggcgcgcacctcctcgatgatggcgttcacacgcccctcgtactccccgtaggagttcgggctgcgctttaacagattctccagtatattctgctgtgtctctttggttaacgttaagattctcatgccagatccttcctttctatctctctctttaaatccgcgatcagcttcgtgatccgttcattttccatcttcatgctgacctggttgaccaccatccgtgcagacagcggacatacttcctccagaaccaccagaccgttctcgcgcagagtcgagccggtctccacaatatcgcagatgacttccgagagcccgacgatcggcgccagctcgatggaaccgttcagcttgatgatctccaccgtctgatgctttttattgtaaaaatagtccttggcgatgtgcggatacttggttgcaacacggatcagttcatggtgcttcagcaactcttccgcatccttcggtccgcagatgcacatccggcattttccaaacccgagatccaagacttcgtagatattgcgtccctcctccagtatggtatccttcccgacaataccgatgtccgcggcgccgtattctacataagtgggcacatccggtcccttggcaaggaaaaaacgaagctttaactcctcattcacgaaaatcagctttctcgtgtccttatccttcatctcctcacaggtaatgccgatcttctcaaacagttccagtgtcttttttgcaagtctgcctttgccgagcgcaaaagtcagatatctcatatcctccatattaaaacgtctctcccttctctgccttctacgcgaaaaactgcacgtttgtcatccggctgcgagctgcataatcctcgtaatctttcctttgcttcgtctcatcccacaacatcagctccacacagcgtccgactgcacgcgctgtcgccgctgcggtaatcgccttctgccgtttggcagatttatagaccatcagctccacacagcgttccaccggaacatcaattttctgtctctgcagtgcagccatcagctggtcaatcacaaacgcaaagccgatggatgctgaatcttttccaaaacaggtgaggagccggtcgtatctgcctccctttacaatcgcctctccgcttccgaacgtatatcccgcaaatatgataccggtgtaatactggtagttgctgatcgttccaagttcaaacgaaacataacgggaaacctcatagacttccagtattttatgaagttcctccagatccccgatcgcctttaagatcctgggataggatgctgcacattcccttgcggcagaaagttcatccgaacccgtgtagagattcccgagcatgccaaagagattctttaagttctcctcgaggtttaaagtctccacgaactcctccacaccgaaaaagttcttgttggaaatgagttcgcgcagttcctcctcctgctcctccaaaagccctgctgcctccatcagtccccggaagaaatccgcatgtccgatgctaagctggaactccttaagccccgccgccttcaggcaggaaatcaccatggagatcatctccgcatccgcatccactgatggatctcccaaaagctccgcgccaagctgtgtacattccttcagtcgtccctgatagctgctgttattgatgaaagtattccccatgtagcacagccggatcggaagttcttcctcgccaaaatactttgcggcacagcgtgcaatcgacggcgtgatatccggtcttaacaccaacgtgttgccttcccggtcaaaaaacttgtagagatccttcgacggcgtggtgccgatctcccgtccgaatatatcaaaaaactcaaatgtcggcgtctgaatcggatgataaccgtgcagacgtaatatatgatatagctggtcctgaagaagcattttcttctcacactcatcattataaatatcccgcacaccttccggcgtatgcaataactgtcttttcatgatcgccctcatttccctgatacttttatactttaccttgctactatggtagcatgatagcaagtgaaactctgtttattataggagatcttagaataattgtcaatccctgcgcagcaaatccttctgcagtgcatccagatacggaaccaaaacgccacgctgccgcggcaggaaatactccgggtccagttcctcatagcggaaactctttcttccgccctcctttgcgcgcttccagaactctaagagcatatccaggcgcagatagtagaactcatcccgcttcgtaaaactgagcaggaaaaaagatacccctccctgtttttcaaagttctccatgaacgcaacctgatgttcatgaatattggcaagtggaaaggtatccgtattacattcttttgcatcaaaacagaccggtattccctgtacggcaccgatatagtccaccgtgctcttctggtcaaaatacgccagcgtgatatgtctggtctgtttgtcgatattgatcggcgtgatcggtgtgggaatcttctgaatcagcgcaagaccgttctcctgataaatctcattggtacggttgataaactcttccagcgttgatccacgcagtcctcttgaattccaagttgccatattgcctccagatactctcttgacacaccggcagttagctgccgtcatgcatctttcatccttttcttttctctattatatagaattctcagtaggtacacaataaaaatatccctttgtcaaacctctccaattatgatatacttgaacccagagaggggttttacccgaagatcctagaatgaaggttagcaatgggagggatgccagatggtcatgaatgagtcaaacgagaattacctggaaacgattctggtcttaaatcatagattgggcaacgtgcgctctgtcgacatcgccaatgagatgaactttaagaagccaagcgtcagcgtggcaatgaagaatcttcgtgagaacggttatattaccgtcagcccggaaggatacatccatctgacggaaagcggacttgaagtcgcggaaaaaatttatgagcgccacacaatcttatccaactggctgacgatgcttggggttgatccgcgggttgccgcagaggatgcgtgcaagatcgagcacgatgtcagtgcggaaagctttgaagcgatcaagcgccacatcaattccagtgcaggaaagatttgaggcggtcagatgccacatccatttccgtacaggaaagatctgaggcggtcagacgccacatccatttccgtacaggaaagatttcatcgaaaacgacaaaaatggaagttcagcttaaggttgaacttccattttttgtgctgcaattctttctgccacaacctgtctaccggttcttacaccactcttccacgcgcgcgaactctgcgccgcagggcgcgatcacttctctcccgtccgcaaagacaatgcggtatgcgtgaagcatctgtgattttaccttacactgtctgcggaactgttcgtttgtgccggcgtcgccgtactttacatccccgatgatcggatgtccgatggacgccaaatgcgcccggatctgatgggaacgtccggtgatcagatgaacctccagcccggtgtaaccgccgcccgtccagatgggccggtacgctgtctcaatcggcgcggcatccgcacttttgggttttaccgtactgacggtaactttattctcacgttcatccttaacgagccaccccttcaagtaatcttctctaaggacttccccttttaccacacaccggtaatacttctggatcgtccgctcctttaatgccttagacatctcctgaagtccctttaaagtctttcccgcaatcagaataccggaagtattccggtccaggcggttgcagactgacggacggaaggtgcgcatctcctcctcggtcagcgctccctccctaagcagatagcttaagatatattcattggcggaaacatcctcgggtctcgccttctgggagagcatgccggacggcttgtttatgataagaatatccgcatcctcataaaggactttaagctgccttaaagtcttttctgaaccactgaaagcttctggcatcaccgtttttgactttgcccggaacttctcgtaggtctcgtccgagagaaacaacttcacctcgtccccgcaggagagcttctccgtgccgtccgcctttttgccgtttaaggtaatgtttttcttgcgcagcatcttgtagacaaaactgccgggagcctctgccagaagcttttttaaatacttgtcaaaacgctgtcccgcgtcgttctcgccgatgtgcaattcctgcatagtctctctccattcgcccgcttactttttccccgcacctgcttttttatgatgaacattgcggattgtctttttcgtatttttcttctcggaagcatttgctcttccgcggttattcccgccgcctgccgtgcggcggttcttgtcacctccagcgtagcggtctttggcgtttgttgtgccgtagccgatgccccgcggccgtaccagacagtgtttgtcaaagccgatcagatccgtccgtcccgctttggttaacgcctccacaacaagatcgtaattcttcgggttccggtactggatgagcgcgcgctgcatggctttctcgtgggggtttaccgccacatagaccggctgcatcgtgcgtgggtcaagtcccgtatagtacatgcaggtggatatggtcgacggggtcggataaaaatcctgtacctgctccggcatatagccgagatctcttaagaattcggcgagttccaccgcctccttcaacgtcgatcccggatgggatgacatcagatacggcaccagatactgctttttcccgagcttctcattcatatcctgataggccttcacaaaccgcttgtacacctccacgcgcggtttgcccatcttctctaagaccgcatcggaaatatgctccggcgccacctttagctgaccgctgacgtggtgttcacagagttctctgaggaaggtgcggtcctcatcgtagatcagataatcgaaacggatacccgaacggatgaacacctttttcacattcggcagttcccgtagctttcttaagagcttcaggtaatccttatgatccacctttaagttcttgcacggtgtcggaaacaggcactgcttgttgggacatacgccctttgtcatctgcttgtcacatgcaggcgcgcggaaattggccgtcggcccgccgacgtcatggatgtatcccttaaagtccggttcccagacgatcttctccgcctccgccagaatggactcgtggctgcgcacctgaataatccgtccctgatggaacgtaagcgcacagaaactgcatcctccgtagcagccgcggttgctgaccagagaaaaacgcacttcctcgattgcaggaaccccgccctgcgcttcgtaactcggatgatacgtgcgctgatacggcagcgcatagacctgatccatctcgctttgtgtcagcggcttcgccggcggattctgcacgacaaaaagctttccgtcgtacgtttcaaacagacgtttggctacaaacggatcggtattgcagtactgggtataaaagctgcgcgcatatgccgccttgtccgccagcacctcctcataatgcggaagctctatggcatcatagatgtcctcacgctttctggtcttatagaccgtgccgtcgataaatgtgatatcgctgaccgccagtccgctgtttaaggcatccgcaatctccacaatgctgtgttcccccataccgtaggagatcagatccgccccggaatccagaagaatggaccgcttcatcttgttcgaccagtaatcataatgcgccagtctgcgcaggctggcctcaatgccgccgataatgatcggcgtgtgcttgtaggtctgccggagcagattacaatagacaatggtcgcgtaatccggccgttttcccatcacgccgcccggcgtaaacgcatccgtcgcgcgccttttcttggacaccgaatagtgattcaccatcgaatccatattgcccgcagacactaaaaacccgagccgcggctccccgaagatacagacagactccttatctctccagtccggctgcgagataattccgaccgaatagccgtgtgcttccagaagtcttgagataatggcgtgaccgaacgaaggatgatccacgtaggcatccccgatcacatagacaaagtcaaactgtttgattccgcgctcttccatctccgcacggctgactggccaaaatccgttgttcattctaatcctcatttctcttcggctgctcattctttaacgcagcaagctcttccgcggtcagtttccggtacgctcccggtgcaagatcctccggcagcaccaatggtcccatggaaatccgcttcaaatacagtacctttttcccgaccgcctcaaacatccgctttacctgatggaactttccctccgtgatggtaagcgtaatctctgacacatccgctttacagcccagaattaccagatctgccggtctgaccggcttctcctccccgatgtcaaccccgtttttaaaaaggttgacatcggtctcatccaccacgccctgcacccgggcgtaatatgtttttgccacatggcgggacggcgacagcagcgcgtgtgccagcgcaccgtcgttcgtgatcaaaagcagtccctcggtgtcgagatccagccttcccaccgggaacagatctcctcttgcggtgtcgctcagataatccatcaccgtgcggtgcatattgtcctgtgtcgccgacacacagccggcgggcttgtgaaacagataatactcaaaagcggtatagagcaggcgctccccgcgcaggcatacctcatcgcccgtctcatcaaccttttgttccggcttttttgcaaccgctccgttcacggtgaccagaccggctttgatctgtttttttacctcgcttctggttcctgcgcccagttctgtcagatatttatccagacgaagtgccatttttctccctcactgtctctttgtctcaccgaatgtgtactttccctgctgttcccagagatataacaccatcggatacgggtttacggaaagttcctgcccgttctcatcgttgatatagattccaaagtgcagatgcaccggaaagttgccggtggttcccggaatatcgctgtaaccggtatcccccatatagcccagatgggtgcctgcaaggactgtctccccaacttcaaactccttcgcatactccgccagatgcgcataataaaaataggctccggacggactgcggatgccgatgcggtacccgccgaggcgaagccatcccacattttccacgactccgtcggatacgctgtatatgggatagatgcctcgctcgttcaccgaagccataatatcacagccttcatgtccccgctcaccgccaaagttcctgctctgcatccagctgtctgcaaagctcactcccgcattcccgtcggaggccaccgtcccgaccggaaaacgttccagatcgtcccacacggcagaaagatagccgcagatccgcgcatatgcctgcggctgataccgttttgcatacagagcctctacggccagctgcccgggatcggtgacgcttccatcctccgcaaaatagacggcaagcagttctttttccgacattcctttttcttctgcctcctcctgcatccgggcaagcagttccccgctcacccggtgttcccggaaactgtaaagcgccgtctcataggaaaaacagtttatctgtctggttctctccagaatccatgcgtttaaaagaacgttccataggatcatggtaaacagtaacagcagcatacggacatgtctgaaattcatatcattccttttttatttacatttttttaaaaatgccaccagaagcttccatactttctcggtcgaggagatggacagacgctctttcggcgtatgaatatcgtaattgttcggtccgaacgatacacagtcaagctccttgatctttccggaaaggataccacactccagtccggcatgaattgcctcaaatactggctcctcctggaacagctcctcatatacggcactgatggtatcgcggatctcggacttcgcctgatactcccatgcaggataatcaccgcttacggcaatctctccgcctaagaactctgcgatatgctccagacggtcacgcagatcttccttgcgggaagacacactgcttcgcacggaggatgtcgcaagaagcgcctgatcctctaattttaagatgccaagatttaatgaggtctccaccagccccggcatcaccgtgctcatatgctgtacgccgttcggcacatggcgcaggtaaaaaatcactctcgccatcgccgtataggaaagaatcgatgcctcccccttctctccgaaagcacagtcaatcgttattcccgcatccgataccgcatactcctttttaagctccgccgtaagttccttaatataggtggtaagctcctcttttttctcctccggaatcagcagacctgccgtacattcacgcggaatggcattgtcctttaaaccgccctctaaggtcacaacgcccagttccatccggtcagagacgtattttaacacacgtcccatgaccatattggcattcgcatgctctttgtcaatctcacttccggaatgtccgccgcaaagtcctgtcaccgtcagcgtcaccgcaagtccgttctgggacatacggtcaaccggaatcgtagtctccaccgtcatgccgcctgcacagctggtcaggaaatgaccctccacatcggaatcaatatttaaaagcttgtgtccctttaacatggacagatcaatcgcctcggcaccgagcattccgatctcctcgtccaccgtgatcacaacctcaaggcgcggatgcgcaatctccggcgaatccataatggcaagcgcataggcaacagcaatgccgtcatcgccgcccagcgtggttcctctcgcctttaagaaatctccgtccacgtagagatccagaccgtccttctcaaaatcgatcgcacagccgctttccttttcacataccatatccatatgtccctgcagaatgatggtatctgcctgctcatagccggctgtcgcctcctgcacgatcaccacgttgttggactcatcctgataccaggtcagatcatgctttttagcaaacgcaaccagataatcactgatggcctttgtgttcctcgaaccgtgcggaatcgcacagatctcctcaaaataatcaaacactttctccgactgtaactgtaatgcctgtatttcttttaaactgctcatagaatcctcctgttcttcatacattctagtatgaaaaagaaattgatattcctttgtctgctattatttatttcctatatcttaaccgccccgaaagatgccgtaaacgccgcatccgtaggactcgttctatggtacacgcgcgttcttccgacgctgctcccctttgtcattctgtccaatatcctgatggactcaaattacctgcaatatctgaacaaaatcaccgcaccgcttgtatcccggctcattccggtcagcgacaacggggcttttgttctgttaagcggctttctgttcggctttccgatcgggagcaaaaactgcgccgccctgcttgcaagcggaaaaatcacacgccgggaagccgatgttttatttatcattaccaacaacatcagtccggtctttgtcacaagcttcatcctctacacccagttaaagctgtcccatctgtcggcagttaccctgctgatcctgtattttccggcgcttttgctgggcagtatcctgctctctacagacgcacgccgcacaaaagaccgcaccgcgttccacgcgcaaaaacagccggcatctggatctcaaatgaattttaaaatcatagataccggcatcatggatggttttgaaacactgaccagacttggtgggtatattatgctgttttccatgatcgcctctctcctgcagaagcttcccgttccccatatcctcacactgatccttacaggaatggtcgaaatcacaaacgggattgccatgcttccggactcgggtctgccgcagtccgttcagtatgtgctggccgtggtctataccgccttcggcggactgtccggtatcgcccagacaagttccatgatccgtgacacaccactctccataaaacactactgcatcgcaaagctgcttcttgctgcctgctgcggactgctcgcctgcctcgtctcacagatctttcatctgtgagacagtgcgttcggtcagcccagcatatccgaagagatctccaccttcggaccgtctgcctgggatgcctgcgcatccgtcgtcttggtctccggctcctcggcagtcggattaagctcggcacggttcgccgtcactacatccaggaatccctgcagggaacttacataagcatcatggcgcgccttcgccgcatccatggaatgtgagatcgtgttctccagattccgcagaatgtcatccgtatactgcatggcacccatacggatattgttggcgtcattcgttgcattatcgagaatctcctgtgcctgcttggttgcaatcatgaccacttcattcgcctgcgcatatgcctgctgcatgatctgatgctcgctgaccagctcgtccgtcttgacctgcgcctgtgcgatgatcgcatctgcctttgcctgggcatctgccagaattgcttccttattgcttatgatcttctgatagcgtttgatctcctccggtgtcttgatgcggagttcgttgagcagctcctccatctcttcgcggtttacgataattttagaagaggaaaatgtctgcggcttgcagccatcgatatactcctcgatttcttctataatctgttcaattctacttgccataagcctctccttattttgagatgtgatatttctcatagatcctgtctatgaatctcgccggaacgaacttggagatgtcgcctccgtaggatgcgaactccttcacaatggtggaactcagataggaatactgcaggctcgtcgtgagaaaaatcgtctccacttccggattctccacatgattcgtctgtgcaatctgaagctcgtattcaaaatccgtcacagcccgaagcccacgcactatgatcgtcgcgttgatctccttcatatagtctaccaaaagaccgtcaaaagatgcaaccgtgacattcggcatggattccgtcatctcttttatcatactaacacgttcgtcaagagaaaacaacgaattttttgcgctgttattcagtacgccgatcaccagttcatccacgatttttgcggatctcttaatcatatccagatgtcccagtgtaagcggatcaaaacttccgggatatattgccctcttcataggtttcttctccttttcgcatgctccggctattttctgcggataaatgcgtgctcatttgtcttgtacatcttgaggcgtgaaagtgtcattccatactcatccagatagctgaaatccgtatctaacgcagcctctacgatcagaaccgtgtcctcttttaaaagggaagatcctgcaagataccgtaaaacctcctgctccattcccttgcggtaaggcgggtccatgaaaatcaggtcaaactgatatttgccctccatggcgcgcagcgcgctcaacacttccgtcggatacagctttgtctgatgttcaaacttcgtaaaccggatattctcctcgatgcaggctgccggctttttgccattgtcgacaaacaccgcatagcgcgcgcctctgctgactgcctccaatcccatctgaccgcttcccgcaaacagatccaggaaatatgccccgggcacttcatcctgtatgatattaaacagcgtctccttgatccggtccgtggtcggtctcgtatccattccctccggtgccttaagcggcaggcttctcgccgttccagctatgattcgcatatggttccctcctctgtgatcgtgcgggcaagtaaatgaagcgccgcatctgtggcacttttccgcacctgcatccggtctcccgcaaacagatgccgttccgtgacaacccttccgtgcaggcagcagccgatgtagacaagcccgaccggacattccctggttccgccgtccggtcctgccacgccggtcacagacagcgccgcatccgtatccgccgtccgcgccgcagataccgccatatccgcagccgtctcggcactcacaacgccgtagcgctcaatcgtctccggcttcacatggatcatcttcaccttcgcttcgtttgaataggtgacatatccctccgtaaaaaatgcggagatccccggcacattgataagcgttgaggcaatcatcccgccggtcgcggactctgctgtcgtgagcgtataatgatatttttttaacaattcaaaaatccgatactccgacatttcatcaagcatcttgctgccgttctgtccctctgctgccatcttttcttccttctctatttctggtcttttaagacgtctttgttcttcacaatgtaatcgatcagagataccacggtcagaatcagcgccacatacgtcagcacggtgccgagaatctggaagaacggcatctggatgtcaaggatcagaacgatcaccatcagcatctggaacgttgtcttgaactttccccagtagcttgctgcgatcacaaccccgttgtcggatgccaccagacggaaaccgctgatgataaattctctcgcaatgatcacaatcacaatccatgccgccaggcggtcaagctcgatcagacagatcatggcagagcacaccagaagtttatctgccagcgggtccataaatttgccgaaatttgtcacaagattgtactttcttgcaatcttgccgtccagcatatccgtcaggctcgccacgataaagatcgccactgcaatatagttgccgtatgccgggaaataaggcgacagcagaaagaatacaaaaaacggaatcaaaattacacgcataatggttaatttgtttggtaaattcataacaattctcctatcaaatcatactcgtacgctcctgtcactctggcgcgtacaatatcaccggtcatcagttcctcgtccgtgttgatgaaaatgtagccgtccacatccggcgcatcgcggtaggtgcggccgatataggcattctcatcgctcacttttccttcgataaagacataaagctctctgcccttcatctcctcgttcttgtcgaagatgatctcctcctgcagttccatgacatccgcctgccactctttcttcgtctcctcgtcaatctgatccgggaactccgccgcaggtgttccctcctccggagagtaggtgaaagctccgagtctgtcgaactccatatcattgataaactgcatcagctcctcgtgcatctccttcgtctctcccggaaatccgcagataagcgttgtccggagcgtgatgtccggaatccgctctctcaaatgcgtgataatgcgcacaagatccgcgttgctggtgcgtctgcccatccgctttaacatggtatcgttggcgtgctggatcggcagatccaggtagtgacagactttctcattgcgggcaatggcgtcaatcagctcctcatagatctcctccggatagcagtacataatgcggatccagaacagtcccggaatctcatttaacgcatccagcagcttgtggagggacttctccccgtagagatccacgccgtaaagcgtcgtctcctgcgccactaaaatcagttccttcgcgcctgccgccaccagctccttcgcctgtgccaccagctcctccatcggaacactgcggtaattgccgcggatatacggaataatgcagtaggtgcagcgcttgttgcaaccctccgcaatctttaggtaagcaaagtgtccgcccgtcgtcacgctccgcttggctgtaagcttcggcagtccctccagcgtctcaaaattctcgtagaacctgccgcccagcgcctccgttatggcattcacgatatcttcgtaggaattggttccaaggatcgcatccacctccggaatctccttgcgaatctcttccttgtagcgctgcgccaggcatccggtcacgatcagcgcctttaactttgcatcgcgcttgtgctccgccatctccaaaatggtgttgatgctctcttccttcgcatcgttgataaagcagcaggtgttgatgatgatgatatccgcctgatattcatcatcggtcatctcgatcggctgtccgtcaaatgtgccggcatcccggatcattccaagcatgaattccgtatctaccagattcttgtcacagccaagggatataaataataacttcatcgttgtctccatcattgtattttaacgccaaaaaggatgataagcatatcatccttttcccatctgaaactatctgaaaaaatgattactcttcctcggactgtgactccggaataatctttaccttgccctcataaagttcttccacggcaatggataacggcttcgggcaggtgactttatctgccatcggctcatctccggcgatgatctggcgtgcgcgctttgcagctgcaatcaccagggaatagcggctgtttaccaccggttcctcaccgatctctacgccctcgttgactaccttcattaactctacataagatggatgtatcataataaatctcctttctgacgccctgttactgacgcgtgaagcctttcagctcgtttctcatttcacggattttgtctgcattgcgcgctacgcggtagtgctcattctggatgatctcatgcacttccctgaccgcttcctccagcacatcgttgactaccagatagtcgtattcctccagcccttcggcttcttctaacgcgcgtgccagccggtgttcaatgacgtccatggtctctgttccacggccgatcagccggttcttcaacacttccgcgctcggcggagtcacaaacaaaagcagcgcatccggaaactgtctgcgtacctttaaggcaccctgaatctcaatctccaagatcacgtccttgcccctggcaagctgctcttccacatatgccttcggtgtgccgtaatagttgcccacatactctgcatattccacaagcgcatcgtccgcgatcatctgctcaaacgcttcgcggctcttgaaaaaatactcgataccgtcgcgctccccggttcgcggtgcgcgcgtcgtcgcggaaatcgagagcgcgtaggtctcgctgtgtgcctgcatgagcgccttcatgatcgtaccttttcccgcaccggaaaaccccgatacgactgtcaaaattcctttattcttttgcatcgtcataatcctctgcggtattgccgttaaatcttcctgccagtgtctccggctgcaatgccgacaatataattttattattttcggtaaagatcacactcttggtgcgtctgccctgtgtcgcatcgattaacgtctccgtctccttgccgcgctgtatcagccgctttgccggagcggaatccgacgagatgatgcttatgatcttatcggtgttgaccatattgccaaagccgatgttgattaacccagccatggacgccacctactcaatgttctgaatctgctcacggaccttctcgatgtccgtcttcagattgatgccgacgtccgaaaccttaagatcggtcgtctttgagaggatggtgttcgcctcgcggttcatctcctgcgcaataaagtcaagctttctgcccatgccgccgccggcaagcagggtctccttcatgcttaagatatggcttctgagacgcaccgtctcttcatccacgcagatcttgtcggcaaaaatagtaatctccgccgcaattcttgcatcgtcgagctgtctgtcgcccaggagttcctgcactttgctctccagccgcatgcggtactcctccagaacctgcggcgagcgctcctcaatgtaatccacataggaaatcatgccgtcaagcttctccacgagatccgccctgagacgctctccctctttgatacggctctccacaaactgcactgccgcctggcggagcgcctgctccaatcccgcccaaagcttctgctcatccgggctctgctcctccatcacgaagacgtccggatagcgggacaacgtgctcacgcgcacgtcattctcgatgccgaactgctctgccatctccttcagataggtcatgtactgctctgcaagccccgcattgtattttaacgaataattctcttctgtgtaatcttcataagatataaatacatccaccttgccgcgctcgatatattcctttaacagactgcggatcgcactctcaaagaaattcagcgtcttcggcagcttgatattcacatccagataacggtgattcacggacttgatctccacggtaaacttgcggcttgcatccgcaacctccgcgcgcccgaaaccggtcatgctcttaatcattcactgtctccctaacatgatatcttctgatgctaattcgatttattataaatcgaatccggtttgaagtcaagagccgcaaaatgattccttacgacatgacagccattctctatgacatacaggtgccgcatggcatgccatgcggcgtgtcatgcggcatatcgtgccatttaggcatgtgtctcctgctcgtagggcatcacttccgccagaaagccctttttctgcagtgcatgctctatctcgtcgagcacttcttcgctttccgcggaaatcttgtgaaaatgatagccggaagtcacattcaaaagcggaaccgattttccggttctaagatcatttaaaaagccctgcacatcccgccggttcctgatattgagcgccgcttccacgcgcccgtaaaccctgtggttcaccatgacatttaagacggtaccgcccagatcaacgatcgtcgtgagttcctcctccacctgttcattggtatggcagaccttaagcacgcgggtcgcacatttcggttcgttgagcagatagcccttcgcggtcgacacaatcggatacccttctgttctaagcagcgcaatgtcctgcaccacgacctgccggctcacccccgtgacctgtccaagctgcgtcccggagagcggctgttccgactcccgcatcagaaggatcagtttttttcttctgtccgcaccggtcatttctttttccatagattttctcacccttccagcacacgcaaatgtttcagactgatatccaggatcggcgcagaatgtgtcagcgcgccgctggacacgtaatccacaccaagagatgtaatggtcttaatattttcctttgtgatattgccggaacactcggtctcggcacgtccgtcgatcacgcggatcgcttccgccatctgctccggtgtcatattgtcgagcatgataatatccgcgcctgcttccacggcttcttttaccatatcaaggttctctgtctccacctcgatcttgcgcacaaacggtgcatatgcctttgctgccgccacggcttccttcacgccgcctgccgcatcgatgtgattgtcctttaagagcacgccgtccgacagattatatctgtgattgcatccgccgccgatgcgcaccgcatatttttcaaaaatacgcatgcccggcgttgttttgcgggtatctaaaagcttcgtcttcgatccctccagaagcttcgccacgctgtgcgtgtaggttgcaatgccgcttaagcgctgcagatagttgagtgccgtgcgctctcccgacagcagtacccggatatcgccggtcacaaccgcaagggtctgtccctttttcactttctcgccatccttcacgaagaactccacctgcgtcttttcatccagcagtgtgaacacacgctcgaaaatctgtaaacccgcaatgattccgtcctccttgcagatcaactgtacgtcgccctttttgtactccggcatcacggcgttggtggagacatcctcactgttgatgtcctcctctaacgccatcttgatatatttgtcagcaacaagctgcatggtaattggattcatgttcttcttttcctttctgtgtaagttcgatcttttgtgcggcgcgctttgcaaaaacaaggctctccaggagactgttgctggcaagccggttcttcccgtgaaccccgttgcagcttgtctccccgaccgcatacagatgcggcatagtcgtttctgaatcgcgatccacatggacgccgcccataaaatagtgctgtgccggaacgatcggtgccggctcctttaagatgtcatagccctcttccagacatttctcataaatatgtgggaaatgtcccttgatgatctcctccggtacgttctcaaaggagatgaattcatggtcgacaccctctttttccatctcctcgcggatcgctttcgtcacgacatcgcgcggaagcagttcgttgacgaaccgctctcccttgtgattcaagagaatcgcgccctcgcctctggcggactctgagatcagaaagcttctgcccggctttttgctgtagagacaggtcggatggatctgcacataatccatgtgctccaattctactccgtgctgctccgcaatccggcaggcatcgcccgtcagaatcgggaaattcgtggagtgctcatacagaccgccgatgccgcctgtcgccatgaccgtatcctgcgcatggatgtgcagcgtctcgccgtcccttgtcttcgcgatcatgccgcagcagtgatcattcacgacgagaatatctgtcattacagtatattccatgatggtcacattcgtcaattttttcacatgcgaaagcagcgtcgtggtgatctccttgccggtgatatcctcatggaaacagattctcggtctggaatgtgctccctctctcgtgtaggcaagcgtgccgtccggattcttcgcaaaacggaccccgagggaaagcagatcatcgatgatcgcccggcttccgcggatcatgagatccacgctctccttccggttctcataatgtcccgcccgcatggtatcctcaaaataggaatcataatcgttctcatcatgcagcacacagatgcctccctgtgccagcatggaatcacagctctccagatcttctttggacagcatcagaatcttcttgtctcttccaagacgcagcgccgtatacagccctgccactccgcagcctgcaatcactacgtcatagtacatatctctcatcttatttattccctcttttcgtatcccggcatctgatacgccggtcacatttcatccgagtatagcacatatctttacagatgacaagacagttgttatgacaaattgtcaagacaatttgtcagacaatttgtcatgtataattccaaaataaaaaagacatattatcgaaaagggatgccgtcgcttcagaccaggttcccaaaaggagacaactatgattaacgaagataccatttatctgctgcgcgagtgcaacgccggaacgcagatggcagtctattccatcggcgagattctggaaaatgtcaaagatcagaagctgcgtgagattctgatctcatccaaaaaccatcacgaacagcttggcaacgaactgcatattctgctgcagaaatacggcgatacgacaaaagacccgggcgtcatcgccaagggcatgtcctggatcaaaacgaacgcaaaacttgccatcgacgacagtgaccgggtctgtgcagatctgattacggacggctgccacatgggcaccaagacaatgcagcggcacatcaaccagtaccttgccgctgaccgcgaggccagaggcaaggcagaagaactcatccgcatggaagaactgctcgcatgcgaactgaaaccgtttttatagacagaaaaaccctgcgccgcatccggaatttacaccagaaactcccggattttttccagcacattttccgtctcatcatagatggaaagtgtgagcggcacagtaagatccattgtgcagattcccagaatggacttgccgtccaccgtgtaactgccccgcccaagatcaaacggtccctcgcaggcacttaggatattgcagaatcttagtgcgcgctccggcgcattcagcagcacttctacctgtttcacgaataccatacctcctgtttcttttatggtatagtattccagactttccgctgccgtaatcaatcatttacatctttttgctagatcagtgtctcgatctcgtcgagcacttttccgaatacatcgagtgcatcctgaatcggcttcggctcctccatattgatgccgacctgttttaacagatctaccggagacatggagcatccgccggagaggaacttcttgtagcgctccactgccggtgcgccctcctcgagaatgccgtgcgcgatcgccaccgctgcagaaaagctggtcgcatactggtatacatagaaattatagtaaaaatgcgggattcttgcccactcataagcgatctgcggatcggagaccatatcctcgccaaaatacttctggttcagttcgtaatagagtttgcagagattctcagcatttaagctttcgccctcttccgccatctggttgcttttcatctcgaactccgcgaacatggtctggcggtacactgttcccttaaagctgtcgagataatgatttaacaggtaggcacgctcttttttgtccgtcgtgttcgcgagcagatactccatcagaaggatctcgttgcaggtagaggcaacctccgccacgaaaatcttgtactgggagtaaatataaggctgatttgcattcgagtaccaggaatgcatggcatgtcccatctcgtgtgcgagcgtaaacatgttgtctaacgtatcgttataattcaacaggacatacgggtgcgtgccgaacgcgcctgccgagtatgcaccgctccgcttcccctcgttctcatagacatcgatccagcggttctcaaagccttcctttaccgttgcaacgtagtcctcaccaagaggtgcgagcgccttaagcaccgtctccttcgcctcatcataggaaacctttttggctgcatccgcgatcatcggcgtgtagacgtcatacatgtgaagttcgtccaccccgaggcacttcttgcgcagctttacatagcggtgcatcttgtccatgttggcatttacggtctccaccagattgcggtaaaccttcaccggcacattgttcgcatcgactgccgcttccagcgtagacgcataatttctcgccttcgcatagaaaatctgctgctttacctgtccgttgtaaagtccggcaatcgttccggcaaactgtttgtagatgctgtaaaaagcttcaaacgcatcttttctgacgcggcggtcgcccgattcctcgaacggcacaaaattgccgtgggaaaggcgcaccttctccccgttttcatcctcgatctccgggtagatcagatccgcattgttgatgatggaatatacctgctccggcgtctgtgccatctctccggtcatcgccaccagtttttccatctccgccgagaggacatgctctttggtgcgcaggatctcatctaccagtccgcggtagagttccagttcctttttttcagcaaaatactgtgcaagcgtcgctttgtcggctgccagaatctccggcacaacaaatgccgtgcggctctgataatccgtcacaacaccgtacattttctgcgacattgcctgatgctcggtgttcttctgatcctggtcaaacaggcgctccgcataattaaacgccagatcgatcttctgctctgcgcgcgcgccaagctccagcgccgcaagaagcttctctgcggaagccataacactgccctctaactttgcgagatcagaaacgatcgcatccacttccttaagatctgcctcccatgctgttttagaagcatacatcgcacttacatcccatgtatattcctcttttacctcacttctttttggtaattcttttgccatagataacctcctgtccggtgtccccgttttcggtcgcaccgcataaaataagggttataaaatccctctcttaatttaccttccctaagccgaattgtaaagaccaagtttgttttttctaactccccgcctcctctttccatttgtattttgcggcgttttctactataatggattcacattatttatgaaggagtacaaacatcatggcttttgacggatttgtcatatccaatttagtatacgaattaaacaacacgattctgaatgccaaaatcagcaaaatcgcgcagccggaaaccgacgagctgctcttcaccttaaaaggatcaaacggccagtaccgccttgccatgtcggcgagcgcttccctgccgtttttatatctgaccgacgccaacaaaccgagtccgctcaccgcgccgaatttctgcatgcttctgcgcaagcatatcgcaaacgggcggatcgtggagatcagccagccgcacatggagcgcatcatcaactttaagatcgaacacttagacgagatgggcgatctgtgtcagaaaaccttaattgtggagctgatgggcaagcggagcaatatcattttctgcgatgcaaatggcagaatcatcgacagcatcaagcacgtatcggcggcgatgagttcgctgcgcgaggtcctgccgggacgcacctactgcattcccgcgacgcaggacgaccgtctgaatccgttggaggtcacggaggagacgttttgggacagcgccatgacaaagccgcttccgatcgcgaaggcgctctacacctcttttaccggcgtcagccccgtcgtcgccaacgagatctgccaccgcgcttccatcgacggcgacatgtccgtggattcgcttaccccggatgccaaaaagcatctctatcacaactttgcctggctgatggaggatgtaaaagagcaccgctatgagccgaacatcatcacccgcggcagggagccggtcgaattttcctgcttccgtctgaccgaatatgtcggcagcgatgatgccgtggaagccacaaattctactgttgccacggattccgccggcaacgcaggttttgccggtgcagacgcaaacgaaagcgaatacacgatgcagcacttttcttcgatctcagcggttctggaacagtattacgcctcacgcaacgtctacacgcgcatccggcagaagtccgtcgatctgcgccggattgttgccaccgccctagaccgcaaccgcaagaaataccagctgcaggaaaagcagttaaaggacacggaaaagcgcgacaggtacaaagtctacggcgaactgatccacacttacggctatggacttgcggagggcgcaaaggaactggaggcgctcaattactacaccaacgagatgatcaaaattccgctcgacccgatgcttgatgccaaggcgaatgcccagaaatatttcgacaaatacaataagttaaagcgcacgtatgaagccctcacggatctgaccgcggagacgcgcgccgagatcgaacacctggagagcatcgcaacctcgctcgatattgcactcacggaagacgatctcgtgcagatcaaggaagagctgatcgaatacggctatatccgcaggaagcgcaccgacaagaaggccaagagtaagagcaagccgttccactaccgctcctccgacgggtatgacatctatgtcgggaagaacaattaccagaacgaggaactgacgtttaaatttgccaccggcaacgactggtggtttcacgccaaaggaatgcccggctcccacgtcatcgtaaaatccggcaacgacgaactgccggaccgcgtctttgaggaagccggaagactcgccggttattattccaaaggcagggacaacgacaagattgagattgactatctccagaaaaagaacgtaaaaaagccgaacggcagcgcgcccggctttgttgtatactataccaattattctctgaccattcacccggacatctccgggctgaccctgatcgagtaaaagcgccctaggcttcgatcagtcctgctctgcgcatctctgtgtatgcgagcaggaacgggccgacgccctttgcatcatcttttaccaccggctccgacatataataatcgtaggtgccggagcgcatctgttttccgccaagtccggcaactaagcagatgccgtccaagtgcaggcttccgtccgcatcctcagagagatatttctcacagatgccgtggaatgcctttgcaccgtatgtctgatagttctccggcagaaagcccaggcgcacgcccttaagcagcgcgtatgccatgatcgagcttccgctggtctccagataattcttttccatgcctccaaaattcacaacctgataccacatgccgctggcgtcctgatactttaacatggcatccatcagatccacaaacacgccctttaagcgctcatacggctcgccaaccgacgcgtccgccttgtccaacgtatcaagaagcgccatggaataccatccgagcgctctcagccagaaattctggcttaatcccgtcaccttgtcacaccagaacatctctctggaagaatcgtaggcatgatagtacagtccggtcttcggatcacgcatatgttccaccacattgaaaaactggcggaaaatatcgtcgtagttcttcttctcatgaaatctcgtctcatactccatataaaacggctgacacatatacagtccgtccagccagacctgattcgggtaaatattcttgtgccagaaatttccctctgccgtgcgcggcatctgctcaatctggctgtatacaagatcaatcgctttgcggtatttttcttttccggtcagatcgtagagttcaaacagggttttccccgcattgacattgtcgatatttaactcttctaccgaatagccttcaatcgagccgtcctctctgaccttgcagtcgataaaattgtcggcaaagcgaaaatatttctcgtcttttgtgatcgcatacatctcaagaatcgccttgatcatgcatccgtctatgtaattccaggtggactttaagccctgcagaatcttctcaatattccagatcgggcggtccggagtactcttctccagcaattcgtcaatataggtttctattttgtccatgttctgctcctttatctcggggatttttcaaaaaacatccccttgattatagaagaatttcggaaactatgcaatagatatccctctcttttccagtggtgcatctcactcggcattttttaatgcctgatccatcggaatttttctgatccgcataaagtcaaacatcatcacgatcagataaccgatcagaacaaacgcgaacattttcacatagcccgccggaagaatgacaaaggaaaaccatccgctgtaactgtacatgatcactttccatgcggcattcatcacgagcgcgccaagcaccacgcagattgcatccgccacgatcacaacaatcgtggtcgacagcagataaatgctagcaatctcccggttctcatagcccaggatctttgtcatggaaattgccgtctcattcttctcaataatgatctttgtgagaagatagattaacaccgcagacagcaggatgcataagatctggaaataactcatatacgatcccatcgagtggtccagctgatcgcacattttcgtgatgtcctgctccgtaattaccgtcgcgatattttcctccgcaatgtccgtaatctccgtgtccgagaaataaccgccaaacgcatccgcatcctgttcaaatacctcccggtaattttcaatcggcagaaatacggcaatgctctgggacttgtcaaaaatgcccgccacccggaaggtatactgctgattctcgtacttttcatccagtgtgacatcgtcgcccacagagacatcgtatttgtctgcataggaggcggaaatatatgcctcgttctcttttaaataattaagatcgtcgatcttcacatactgactttcatcggagatgccgtagaccgatacctcctcgtcgagcgtatcactcttccgtaaaagagatgtcatgctgaatttttccgcacccggctcctttgttgtgatgatgtcgccgtcctcatcctcccaggacgcaagcacatactgatactttgcgaacatcagatccttggcgttctccttatagtagctgagcgtatccggcatgccgaccgccatcgccagcatgaccatgcagaaaaatatcccgacaaaaaggaccgcataatttgccatattctgaaacatgacgcgcagacggaaacggctcaaaaactgaaaccgcggcaggagcatcgcctttttacgctttgtcttctttaaatcatgccgcaaaaactgtaacggcatatggcgcatcatccgcgcaatcaccacaaggttcacaacaaacatcagaatcagcggaatcagcgtcgtctttataaacgcatccggattccatatcgtctcgtaggtcggaagactgtagctgttatagtacatcgaaaccacaacatttttgaacaccgtatatccgagaatgtttccgatcagcgccgcgacgagcgtcacaatgaccggcatcgacagataatgcgccaccagttccccgcgcgtgtaacccgaagcgcgaagtgttccgatcgtggacgactccctggcaatcgtgttgctgattgtaatggcaaaaataaaagcgataatcacaatcagaatatcgagcagcacaccgcccatcgcctcatcagagcccatgtcatccgttgcaaaatgaatggcagggttcgcatattccggaacataatcctcaatctccgcatccgcgacaaccacctgcgtcagcagggctttcataaaatcatccgacagatttttttctgctgcctcatccgccggctctgtcacatagttccatgcataatcatagtgcaccttctcgtgcaggcgcgcaaacccgtcttccgtcaccatcgccacattgaatttcagcgcatcgaacatcagatccgtacttttttcatgcagtgtggcatagttgacataggcaatcagtccgacgacacgatacgcctctcctccaaccgttatggtatctcccaccgcaatgccgacattgtccgcatgcatgcggtccaccgcaatctcatcagaagatgccgggaagcttccctccatcaggcatgccagattgatgtcatctgtcttctgatagacgcggacggttccgtccgagacgccgtcgccgtcgtgatcctcctcctcattgcggtagaaattctcggatatgttcaccggaaccgccgcaaaatcaggatagttcaattcgtatttgtcttccgccttttgatatttttcatcaatttcatccagaatcttgtcccaggcttcgtcgtaagccttctcgtacgcctcgtcatgtgccttcccatacgcctcgtcataggcggtatcgtaggctttctgatacgcgctctcgtaagcggcatcgtaggcctgctgataacttcccgcctgctttgcctgcgccaccgccgtatctagcatcgctgcagccatggtctcatccatcccctgtgccagcagtgtctgttttacctgcgccgcaaatgtctggtcgaactgtgtctgaaattccgcattgaatttccggtcaaattcctccttgaactggctgtcgaattcgtccttgaacttgtcctcaaattcatcgtcaaacttctcatccagctcacgccttgccttgtccgtgtaatactgctttacatccgctttctctcccgtggcaatcgcggcgagcagtgtctgatccgcctcctcattcagttcaaaatgtccgtcctccagcttatatttcgtgactccctcatctgcagccttcatcatgctctcgttggcaacgtacattcccgatacaaagccgattgtcaaaatgaggaacaggctcacgagcagatattttctccagtctcccgccagttccctcggtatgcgtctgatcagcggatttcttgtctttttcttcttcatgccggtcacactccttaccattccagatctgccgctgaaactttatccgtgttgatctcattgtgacgtacttccccgtcgcgcagcttgatcacatgatctgccatatgccggatcgcctcgttgtgcgtaaccataataaccgtattgccgtattttatattcacatcctcgatcagctttaagatctctttggacgtatgataatcgagtgcgcccgtcggctcatcacagagcagaatatccgggttcttgacgatcgcccttccgatggatactctctgctgctgaccgccggagagctgattcgggagcttgtatctgtgctcataaagtcccagcgtatgtaacagttcatcaatatccagcgcatgatcggacagatacgcgccgacctcgatattttcctttacgttcagattcccgatcaggttatacatctgaaagacataaccaagatgcttgcgccggtattgcgttagtttcttctcactcatctcctccagcttatcaccgccgatcgagatataaccggaatccgcgctgtcaatgcctccgataatattgagcagcgtcgattttccggagccggacggtccgagcagcacgcagaactctcccttcgccacggaaaagttcatcccgcgcagtacctcctgccgtgtctcgccgcttccaaatccctttttcagatcaacaatttccagaaatttcttttcttcctccgacataatctcctctttccggaacatccccatgcaggaatattcctgtttcctttttgcagacagccgttagctttaactaactttttcacattatatcatagtcccgcaagattgcaagaaccaaaccgcagggaagcctgtacaaaaaatggaagctttttcctgtttttttgacaaaaactgcatgtttatctctcttaaattctcacatactattcctgaacaaacgcagatggcgcaagttcagacgaagtctgtgaccaaaaagtctaagacagacaaagtgatcataacaatgataacaaaggatcattaacacaccaaaggaggaaacaatcatggcaaatcgttcatctaacagagcagcaatccctgaggcaaaaagtgcactggaccgcttcaagtacgaagtggcgagcgagatcggcgtgccgttaaaggacggctacaacggagatcttacctccagacagaatggttctgtcggcggttatatggtcaagaaaatgattgaggcacaggaaaagcagatggcaggcaagtaacccgcccgtcgcagacattccgagaaagagaaaaaaataccaaagaaaaagacgggaccggcgcttgcaccggtcccgttttatgtgtgaaattataagctcatctgattctgttcccgcataaggaaagcttcgagataatgccgcaggttctcatgctcaccggacataagatccggatcttctgcaagcagttcgccgaccgcctccgatgcatcccgcagcacggcagcatcctgatagatgtcgccaagtgcaaactgcagttcgccggactgacggatcccgaagaaatcccccggcccccgcagttttaagtcctcgcttgcaatccgaaatccgtcattggaatcatttaagatcttaagtctgcgctccgccgtctttgcgctcgagcagttcaccataatacagtaggactgtgcatcgcctcttcccacacggccgcggagctggtgaagctgcgccaggccgaaccgctccgcattttcgatcatcatgaccgtggcattcggcacattgacgccgacttccacgaccgtggtcgccaccagcacctgcacctcatttttcataaatgcctccatgactttgttcttctgcgccggtttcatttgcccgtgcagcagtccgagctgaatctcctccggaaaaatctgccggagtttcttgacgtagtccgtggcattctccgtctccatgccctcgacttcctccaccagaggacagatcacgtatgcctgatgcccgtttttgacctcattttcgataaatgcatacgccttgttccgatagcccgtattgaccacgcagtttttgaccggaagacgctttgcaggcacctcgtccaccaccgagatgtccagatccccatacaggataatggcgagcgttctggggatcggcgtggcgctcatcaccagaatatgcggatgtctgcccttttccgcaaatatttcccgctggcggacgccgaagcggtgctgctcatccgtgatgacgagcgccaggttatcgtagatggcgcgctcctgaatcaacgcgtgtgttccgaccaccatcgcattgggataaagctgcagcgcctcgtatgccatgcgcttctgacgcgccgtcatggagccggtgagaagcaccaccggaatctttaatccaaactcttcgcacaacttctgaaacgtctcatagtgctgtctggcaagcacttccgtcggcgccatgatcgccgactggtaatcattgtgcgcggcatctgccatcgccaaaaacgctatgatcgtctttccggaaccgacatctccctgaatcagccgctgcatgacataagggcttcgcatatcgcgcttcacttccgagagcgcccgcttctgcgcgccggtcagctcatacggcagcctggcaatcagctcatcagtaaaggaatcctcccggaattcaaattcgttggcttccttgatccgcttctccttgtggtactgcatatttaaaataaagaggaaaaactcatcgaacacgagacggttgcgcgccgcgatcagcgtgtccatattttccggaaaatgaatctctttgatcgcataattgtactcgcagattttgtagcggctgcggatctcccggggcagatattccttaaacagttcttctctgccgagcaccgagcgcacggtctttgtgaccagattgttcgagattcctccagtcagaccatacaccggcaaaaatgcctgctccatggcggcgtacgcttccccggaatagatggctgcctgctccatcacaagacggctgcctttgcgcgccaccttcccgtaaaatacataggtattgcccggtgcaagctggcttttgatgtatggcatccgaaaccacaccagttcaagttccgcctcatccgtgccgatggtcgtcaccgtgaccggcatgcttctcgtgcgtctcacaacgggcgtctttctcaccctgccgagtaccgccgccgtctcgccgtccgtgacctccgccacctcttttgctaccgggaactgcacatacgtcctcggataatgaagcagcagatcccccaccgtttcgatatttaatttctggaacagggcggctgtcttttccccgattcccttgatctctattatggatgtactctgattcatactctgtttcccttagaaaaaggctgccgcaccgtcaaccgcctcaagcgatgtccgtgcagcagccctgcctgtgcttatgttatttacacttttcgtcttactcgacggagatcacgtaataatagatcggctgtccgccatagtggacttccacctcgacatccggatgcgcctctgtgatcttttcaccgatcgcattcgctgcatcttccctggcatcctccccgtagtagatgctgacaatcgccgaatcctcatcgatgagctgttcgatcatatccaacaccgtagcctcaagctccttcccaacggcaaggattccctgatcgccgatgcccataaaatcatcctgcttgatctccttgtcatcgatcacggtatcgcgcaccgcataggtcacctgaccggtctttaccgtccccagttcctcgctcatgcgctctgcattctcctccggtgtgctgtccggaatatagttgatgagcgccgtgattccctgcgggatcgtcttggtcgggatcacgatgatctttttgtcctccacaagagaggctgcctgattggctgcgagaataatattcttgttatttggaagaataaagatattcttcgcgttcactttttcgatagcgtttaacatatcctcggtgctcgggttcatcgtctgtccgccctcaataatgtagtccacaccaagtccctgaaagatctcattgataccgtcgccgatgctgacagagataaagcccatctccttcggcggttcctgctcttttggagcttcctcgtccttcagctgcttctccacgtcctcgatggtctccgactgcatctctttttccttgagtgcagagatcttctcgtcacgctctaacttcatattctcaatgatgatcgtcgtaaggcttccgtaagtcagaccgcgctgcatcgcaagtcccggatcattcgtgtgcacatgcacctttacaatctcgtcatcagcgacaacaacgatcgaatcaccgatgctctctaagtactctttgaattccgtctcctgtcttgtggaaatcggcttctccaacataatcaaaaactgggtacagtacgcaaacttgatctcctgcgctgcctgtgcctcaatgttgtaggaggcgcttcccgtctcggccgccggctgcttctccggtgtctcaatcgagtaatcgatctccttgccctgcagggagtcaagcgcacccttcatcacctgcatcagaccctgtccgccggaatccacaactcccgcctgttttaataccggaagcatatccggcgtcatgctaaggacatgatcgccctctttgatgacttcctcgcagaacgcaagcagatcggtcgtctcctcctcgctcagctctaccgcacgtaccgccatccctttggcaaccgtaagaatcgtaccttccttcggcttcataaccgccttgtatgcggtctctactgccttctcaaacgcatcggacaatacctgcacgtcaatctcatcatactctgcaataaccttggtaaacccgcgaaacagctgggaaagaatgacgccggaattacctctcgctccgcggagggaaccggaggaaattgcctttgcaagcgacttcatgtccggctctgccatcgccgccacttccttcgcggcagacatgatcgtcatcgacatgttggtaccggtatctccatctggaaccgggaatacattcagttcgttgatccactctttctttgcttccaagtttttcgctccggccagaaacgcttttgcgagagcctcggcatttatcgtagtgatctccacctcaaaaatcctccttaatcaatcactcgtacgccttcgacgtagatgttcattttcttaatttccattccggtaaacgcctcgaccttatattttaccgtctcgatcagattatcggataccgtgatgatgctgacgccgtaagatacgatcacatgaaaatcgatcgtgatcttgttctcctcatcaatgacgacattgatgccgtgcgtgagataatccttctttaaaagcttcaccagaccgtccttcatgttgactgcagccataccgacaattccaaaacattccactgcaaccgatcctgcatacgttgcgatcacttccggatctattgtaaccttgcccaactgggtctccatatgtccattcatataatacgatgctcctttcaaagccatattaacgctagtttattgctattataaccgctttttgcacaaattcatagccctgttttttgaattttatattttttttaaattttgcttgcaatatgtactttcttctgatagaataatcatgttgtgagcctgtatgctatacaggttttacctgtagaatgtgcgggcaagtcctgcatcaccaggataaaatatgcaaggaggtgcaaaatcatggcaaaatgtgcagtttgtggaaagggcgctcatttcggtaacaacgtgagccattctcatagaagatcaaatagaatgtggaagtcgaacatcaagcgtgtcagctgtaaagtgaacggaacaccgaagaagttatatgtatgtgcttcctgtttaaagtccggcaaagtagaaagagcttaggaaaagtaataacatctgtttcagtcctgctgattcagatgttatttttttgtactcttccctttccataatcgaaaaaacatgactactagaaactgtataaccatcttgatctttcacttccgccttcaattgaaaaaacttatctttatcttcattaataaattctctcattttctggcgtgtaaactgagtaattttatcttacatcagtttggaggtttacacaaactttgggatgctcccgaggaattttattcatataaaaatggagctcttgttttttactcaaaagctccattactgtttatttatttgaatttatgatttcttcaatatcacgaccaccgtagaatattcgagctactgtaactgcccttttttcgtcatcaaccagataatacacaataaaattgtctaccggaagctgatgcattttcatcgaatgccaaggttcccaatgagctaacgcatagcgagctggcatgaaatccaatgagcgcacctcttttcggatgcagccaagctgagcagaagcagtctctggaacaaggagttcattcgcaatgtatgaatagatctcgcgtaagtcgtcaagtgcatctacagaatagccgaccttatagctatctgtcatatgccaaactcctttgcaagtgccgcatcgacttcatctgcagaatatacctttcctgctttgatggaatcaacacccttctggagttctgcatcaagctgttttctggtcattgcaccaacagctaatggcttagaagaaggaagtttcagttcaaatggcatacccttcttcagtacaatctggctataaagcatctgaattgcactggatggagaaatgccaagctgagaaagaatgctctcagcattatccttgagattggtatctattcttgcataaacagcggatgtatttgccatagtatcgcctcctttttctttactatattcgcatttgcttgcgattgcaagcatttacatagattattttatgacgaaactttgaattttatacgccctttgcagaagaaaggaatatttatgaacaagcaccatcaacaaaattctccgtaacgaaaaatacatcggtgatgctctgctccaaaagacctacaccaccgactttctaaacaagaccagagttaaaaataacggtcttgttccacaatactatgtagaagacgaccacgaagccattattccgaaagatatttacctgcagggacaggaagaactggtgcgatgctggatcaagcagatcacgatctgggatgaccgcatcacagttgaattaaaatccggcgtcagcattgatgcagacacataacttcatagacgcacgaaggctcctcaccactggataatttccggcgatagggagtcttcattgtttattctttcatgcatgaactccacttttatatagaatttcagtaaaagttgaggtttgccccagattgtggggcaaacctcatgaattatcttacacactttctgtattcatatttacactctcttattgacaatgtacatctcttccataaactctttataagttttaatgattttctcctttgaatacttctctttctcgacttgatgtaaatatatatgccttgttgaccccgtgacctgtattcgttcctgctgatcgcaaatacccgttaaaagcatcactgttattaaactgatcctgcaaacctctgacgaacaggcaacggatatgatgtttcgcttggtcgagcaaatggctgacaaagagggcgtgaccgaacaactaaaagtagaaagcccgatgttatgggttggaagaatgaatgagatacaagcaagggcgagagaaattgtatatcaagaactgatttatacctaaaaagagggcgacagcatttttgctgtcgctctcttaattaccatattgtaaggacagtcggggctgtcaacggttgagggcagcccatttacttgccgttgactggctcggctgactttgctatctcgtttagtattcctttttcttgaaaatacggacagtcaaaggaaaagataggataaatagcaatatagaaccacttattaaaataaactgtccaaatgacggtatattaaaaagcattgcagcaataccaactgcggaaagcaaagatatgataagaaacactatcagtttatcttcccctgctaaataaatgctaggaataaatattgcccccattgaaaggcttatgctgagtcctaatataagtacacctgctataccttcaaactggttaaaaggaactccatgtaacagataggataaggctgttatactaccaacgaaaagtgtccctatcacaatccacaataactgattgatgtataagccttttacaatatcaatcctttttactggcaaagtgagcttatatttcccccattttgaggaaaattcatttccgatagcagtagctgcatttactgacaatccaacaattccaataattatgaaatacatttgccatgtctggtctgggataatgataacgacaatacccattacaagcataaaaaataaaaatatttttgcatttgtccatacggcaagaaaattatttttgaaaagccctttcatatacgttcccccctcgtaccaatagtaaaaagatatcatcaactgaaatgtggtctatcaccgtatctttgtattttctctgcattgctttacaatcagaaactaggacatcaatttgaaaatcacgctttcgataggcaataatatctgttggatctaatgcaaggaattgattttccttacaacgcataaccgcataattgtaaaccaaatcatttttcgatacggtcataatcattttcccgttatgaataaatgtaatataatctgcaactttttctaaatcacttgtaatatgagaagaaagtaaaatagaatggttttcttcctgtacaaaatcaaggaacgtatctaacatctcatcacgaacaatagggtcaagtccgccagtagcttcgtccaaaataagcagttgtggatggtgtgataaagcaaccgcaatcgctaatttcattgtcattcctctggaatattgtttgattttttgatttgcaggtagtttatattcttctaaatacttcagaaataagatattatcccattgtttataaaagcctgccataacttttgctaattgtgtagccgtccaataagtcgggaaattatctccgtcataaacaacgcctattttttcacgcatatctgtgtctgcgtctgacatttcctgtccaaacagttttatctttccgctgtccttttttattgtatttaatatgcaaccaatcgtcgttgtttttcctgctccattttctccaacaaaccccataattgccccatacggcaagttgaaggacacattttccaatgaaaattttgattttgaaaatgtcttggaaacctgctgtaattctaaaatattttccatgctattcctccgttttataaaataaagttaataattctgtcaatttctcaagagaaatattgtttgttctcccgatttcggcagctatttgtaaatgttcttctgctatacgctgctgttcttcttgataaaattctttgttttgtgcagatacaaaacttcctctaccaaccgtggtttctatgaaaccgtccctttgcaaatcttcataggctttctgaacagtaatgacgcttacctgaattgactttgccaatgctcgcattgaggggattgcgtcaccagctttcaattcgccactcattatcatggctttaatctgtgatgtgatttgctcatatatgggcttgttggcattattactgataatgatttccatacctcaccgccttttatttcacgagtgtacttaatgtgcaagtacattatatcatctatacaattttagtcaacccaataaaacaaaattgtgagaagaaatgagattgctatgtatgccgccgctatgggtaacaccataacggcgttttttcaatgcctattggctatctctgtcaaaggattttttgcggtggcttttgtctgtttcgctcctgtattgtatctcgtgcagatgtttgagtacactctgcttttcgggcggtctgcgctgttctttgttggcggctgcggattttcttctgctttggtattcccactcgacaagatcacggttgtattgctctacaacactttccatttctcggaaaatacgcataaacgcctgtacatcgggataaccgtctttcttcagaacatagggcagtttttccagcttctcagatattttcttttcggtctgctctatctgctcggtaagacttttacgctctttgcctttgaatattccttttacttcggcaagctgtgattttaactttggcagtacctcgtcctgcaagtgtttgatttccgccgctttgtcctgcgcctttatcatcagattccgcatatggcgaaactctgccatatcaatatcaagcgtaggcttgggcagcatatccttttcacggataaggttttgcagaaagtcttttgcctttgccacaatccctcggaacagattaggcagccagcctttgctcttgatagattggcttgctttttcgtgtatctcggtctgcttgacctctaaaatctttgcgccatatccgctgtcctgttccattcctgtcttgcggtattgtccgcttcaatctcggcggctttggggttattcatgccgattttcttggtaggaagataaacgctgttcttatcaaatacctttaactgttgttcgagatcagagatatgccgattgataaggtcggtataaatcgcttttacctcccgaagaaaaggctcgctcttgaatttatcgtctttcacggtaaagaggtgactttcgtaaacctcgctctttttaatgacggtacagcctttccgtagtgacagcagccgaagaacggattgctgaaaaagaaaaattccgtggcactttgacaagtgaaaatgccgattgacattcaccggcataagtgacactattattttacgcacaccatatgtcacagtcccgattgccacggatagaaaggggaattttatctatggcaaaaggttctgtaagaaaaaaaggtaaaaagtggtacgctcgcttttacatcgaagatgaaagcggcagaaaagtacagaaagagtttgtaggaacagaaagcaagtcggaaaccgaagccctgctcagaaaggcaatcgctgactatgaggaaaagaagtttgtcgggaaagccgaaaacatcacggtaggcgaaatgctggatatgtgggtggaggaagaattaaagcccggcaatctcagcaacggtacggtcatggcgtacacgacggcagtcaaaaagattaagaaatatcccattggcagccgaaaactgaaaaccgtgaccgccgaccatttacaggcgtttatcgaccttatgagctacggcgggataaacccagacggtacaacttcaaagcctatgagcaaaggctatatgctgcaattctcggcgatgctgcaagactcattccgttttgcggtatttcccaaaaagctgataacctttaacccgatgcagtatgtaaaactgcgtggcaaaaaagaggaaacagatattttctcggacagcgaggaagaaactgttattcctacgattacacatggggaataccaaaagctggcggacttcttaactgggaagaaacacccagcgctgcttgcggtgcagatagcctattatgcaggcttgcgtatcggagaagtctgcggtctgacttggcaggacatcaaccttgacgagcaatatctaactgtaagacgcagtatgcggtacaatggcacaaggcataagcacgaagtcggcacgacaaaacgcagtaaagtccgtaccgttgatttctgcgacacattggcagacatcttacggaaagcaaagacggaacagcataaaaaccgtttccgctatggcgaactgtatcatctgaactactgtaagacagtcaaagaaaaggggcgcacctattacgaggtttacagtctgcaaaggacgcagggaatgcccgaagatgacagggaattatcctttgtctgcttaaaggaggacggtgcttttgtttctgcaagtgcagtcggtcagatttgccgcaaggcaaaggcagaggtcgagggattggaggactttcatttccacacactccgccatacctacacaagcaatctgctttcaggcggtgcaaaacccaaagatgtgcaggaacttctcggacacgctgagtcagtaccacaatgaacatttatgcccactctaccagagaagcaaagcggacttccgcaaggctcttggataaggttgtgggcgaagcataaaaaatttcccttgtttcggctcataagggcaaaaacaagggaaaatacataaggttttgatatttgataggcggtaagccttgaaaactcaaggaatttcggaagattgaatttttaatatcaatttatgcaaaatcaaacagcgacagctggttcgactccggcagttcgccgagcagtcccagatctgccataagatcgatgaccgtcttggtcgccttggtgcgctgcctgaagtcgtccttggacagaaacttgccatccttcgccgcctcggcaaccgcaatcgcagcattgtcacccataccgtcgatcgtgtttaacgccggcatgagtttgccgtcaatcacctgaaaacgatccggctttgcgcggtacacgtcgatcggcgtaaaatcaaaccctctggcatacatctcctgcacgatcttcatatcgcggtaagtatcctgctcctttttggagagcgaatcttttctccgcgtgtaatccttgtaaaaatattcaagacgctccttgccctgacacatgatctcgtagttaaatcccgtcgcacggatcgagaaatatgccgcatagtaagcaagaggataatataccttacagtaggcaatacgccatgccatcataacgtatgccgccgcatgtgccttcgggaacatgtacttgatcttcagacacgaatctatgtaccactccggcacatcatgcgcacgcatctccgtcttccactcttcctttaagccttttcccttacgcaccgactccatgatcgtgaaggactgctcactgtcaagtcccttctggatcaggtagatcatgatatcgtcacgggtacagatcgcggtggaaatcgttgccagtccctgctcgatgagtgtctgcgcattgccgagccatacgtccgtaccgtgggacagaccggagatacggatcagatccgagaactcctgcggcttggcatcaataaccatctgcatggcgaaatcggttccaaactccggaataccgagacatccgagcggaattccatgaatgtcatccggcgtcacaccgagtgccgatgtatttttaaataaggacatgaccgactcatcgtcgagtgggatcgttgtcgggtcaattcccgtcagatcctgcagcatacgaatcatcgtcggatcatcgtgtccgagaatatcgagttttaacaggttgtggtcgatcgagtgataatcaaaatgtgtcgttaccgtcgctgtcgtcatatcgttcgccggatgctgtaccggcgtaaacgtgttgatctcctctcccaccggaagcacgacgattccgcccgggtgctgtcccgtcgtcctgcggacgccgacgcatccctgcacaatacggtcaatctcacagttccgcttgtggacaccgcgctcctcgtagtaattcttgatgtatccgaacgccgtcttgtccgccagcgtaccgatcgttccggcacggaatgtctgaccgtatccgaaaataacctcacagtaggcatgcgctttactctgatattcaccggaaaagttcaggtcgatatccggctccttgtttcccttgaatcccaggaacgtctcaaacggaatgtcaaacccgtcttttaccagcttcttgccacagaccggacagatcttatccggcatatcacatccgcttcgcccggagaacgccttgacctccggcgaatcaaagtcgctgtacttgcagtaggcacagcggtaatgtgcctgcagcggattgacctccgtgataccggacatggtcgccgcgaacgaagatccgaccgaacctctggagcctaccagataaccgtcctcgttggacttccacaccagtttctgtgcaatgatatacattacggcatagccgttggaaatgatggaattcagctcacggtccaatcgctccttcacgatggacggaagctcctcgccgtacatgctgtgcgccttggtgtagcagatgtcacgcagcatctgatcggaattctcaatgaccggcgggcacttgtccgggcgcaccggtgcgatcttctcacacatatcggcaatcttgccgggattcgtgatgacaacctcctccgccttggtgcttccgagatactcgaactcctttaacatctcctccgttgtccgaaggaacagcggtgcctggtcatcggcatccttaaatcccttgcccgccatgatgatacggcggtatacctcatcctccggatcaaggaaatgcacgtcgcaggtggcgaccaccagcttgttgaatgtctcgcccagctttacaatccgccggttgatatcctgcagctcctcgacagagttgatggcgctcttctcatcccgcagcatgaaactgttgttgccgatcggctgaatctccagatagtcgtaaaacttcacaagacggatgatctcctcctccggtctgccgtctaaaatcgcacggtagagttcgcctgcctcacaggcagatccgagcagcagtccctctctgtactttacaaattcgctctttggcacacgcggtgtcttgtgaaaataggtcaggtgtgacatggagaccagacggtagagattgatgcgtccgatatcgtttgtcgccagtatgatcgcgtgatggctctttaactttttcacaagttccggcgacgtcgcgcccatctggttcacatcgtctaacgtctccatgccgcgttcatgaagcatctcgataaacttgacaaaaatctccgccgtacatgccgcgtcatcgaccgcccggtgatggtgatccagcgatacaccgaccgcctttgccacggtatccagcttgaaacggtttaactgcggcagcaggattctcgccagcgccacggtatctgcgatggtaaaatcaaacggcagtcccatgcgctcgcagttcttgcggatgaatccggtatcgaactccgcattgtgtgccaccatgacggtcccctcgcagaacttcatgaattcgggcaggatctcctcaatcctgggcgcatcgagcaccatgtcatccttgatggacgtcagctgctcaatattatacgggatcggcacctccggattgacgaaggtcgaaaaacgctccgtgatagctccgtccaccaccttgacggcaccgatctcaatgatcttattcttatccggcgaaagtccggttgtctccaggtcaaatacgacatagctgtcatttaagctctgtccttttgagtcaacgataatatccttcagatcatccaccagatacgcctccacgccgtagatgatcttaaaatccgaatccggcggaaccgcatggttcgcgtcagggaaagcctgtacatcgccgtggtccgtgatggcgatcgccttgtgtccccacttcatggcgcgttttacaatatccttgacatccgagacgccatccatatcgctcatcttcgtatggcagtgcaactccacgcgcttctccgggctggtgtctgcacgtgtggacgtaaaatccgcaatctttttgatgccgaccacagaaccgatcgtaagctcactgtcgaacttgtcgatcgtcgtcacacccttgatctttaaaaacgctccctttgcgagtcctccgtcaagcagttcctgcagctgatcgtttctggtaaagatttttaacacaatcgaatcggtaaaatccgtcacggacataatcacgatcgtcttctcattccggatctccctggtctctaacgtcatgacctggcagcggatcgtcacctctcccatctctcccacaatcttctcgatcgcgatcggttcatcctcaaaatcacgcccgtagatcacatccggattgtccgacttcttaaggccgccgccctcgaatctgcgcttgaattccttcttccctttttcgccatttcctgcagtttttcctgcatgttccgcaggttttgcagcattttttgcagaagaaacggtatttgtggtggcattgccgcctgtaccaccagatgttgttgtgccatcggaaaccgcctcggcaccgccttctgcgaccgccggcacactctccccgtcgccattgcggatatgtacctttttcatgatgtttttaatctcaaactgaatctgcagatcactgtttttcttatatttgctttccttcggttcctcgtaggcaagctccaccgccagatcgagtccgcagcgctcacagatcaccttctctaaaaactccacgatctcatgggaacgcgtctgtgcgataatcgtattctccagcgtgagcagcatgtggctttcgctcgtaaactccatcttcgccgtccgaagaagattgtattccatcaggctgtaatctttcagttcttctaaaatgctgtcgcgatacagatcaagcagcttttccggcgtatactgttccgagagatgatacttttcaatgaccttgacctgcatcatcctgcccttaaaaatctgttgtgcaatggcagattccaactggcggatatcttttttgtgaatcagacgcgtgctgcttaaatagacgcgcagatgatcgcgctcatgattcatgcccaccttcgttacttccgtctccgtcagcagatttttcatgtcgccttctacctgcagtgatggaaatacatcaaaaaaccgttttgccatgcccttttctcacttcttcctcagtctgttctacttctgctgctcattccagtgcagcagctcatagcgcaatgcctcaagcagttcgccctccggcacctttttatatacttccccgttcttgatcaaaagtccctctccgattcctccggcaataccgatatccgcttcctttgcctcacccggtccgttgacaacgcagcccataaccgccaccttgatgtctaacgggatgtctgccaccatattttccacctggttggcaagcccgatcagatcgattctggttctgccacaggtcggacaggacacgacctccacgccgcctttgcgcagccctaaggtacgcaggatcagcttcgcggacttgatctcctccaacgggtctcccgtgagcgatacgcggattgtatcgccgattccctgatgcagaatgagtcccagcccgatcgaggatttgatattgccgctgatgatggtgccggactccgtgatgccgacatgcagcggatgatccgtctgtgtcgcaatcagctcgtgtgccttcacgcacatcatcacatcggaggatttgatgctgatgaccagattgtcacaccccatatcctcgatcagatgtactttatcgagggcgctctcgacaatcccctcagccgtcacaccgtgatatttttccacaagatctttttccagagatccactgttgacgccgacacggatcggaataccgcgctcttttgcggcatccaccactgcgcgcacacgctctgtacttccgatatttcccggattgatgcggatcttatccgcaccgtgctcgatcgcggcaagcgccaggcggtaatcaaaatgaatatctgccacaacgggaatgctcacctgctttttgatctcggtcaatgcctccgccgcctccatggtcggcacggcgcagcggataatatcacatccggcagcggtaagcgcctgaatctgcgccacagttgcagccacgtcctccgtctttgtatttgtcatggactggatcaggatcggattgcctccgccgatcacccggtcgccaattttcactactttcgtcatctttttgcctttctatccgaacagcttgcggatatcattaaaaaatgtaaaaaacatgagtgcaaacaacagcatcatgccgataaaatgtaccatgccttccttgtcgggatcgacgcgctttccgcggatcacctcgacaatcaaaaacagcagtctgcctccgtccagcgccggaagcggcagcagattcatcacaccgaggtttgccgataagaagatcgtaatgtaaagcatctgcaaaaataccatatagtagccgtacgtcacgctctgctcatagctgtccccgatcatattcacgattccgaccggaccgctcatgtcattgacgctcacctttccgtccaccaaagactttaagctgtcaatcgtcacgcggatccagtattccacctcatatacgctgtattttaaattggaaagcacggaacctttcgtcttttgcgcgcttccctgaaagccgtacatataatagccgtattcttcgttatatttgggcgtgagcaccgtctgatagcgttctccgtcccgctcataggtcactgtgaccgcgtccccggaatgaaactgtgtgtaggcgctgatgtcccggaaaaaatgtatccgggtgtgatcaatctttaagattgtatctcccgcctgcattcccgcctcctcggccggatatccctccgtcactccggcgagcaccggcagatcatagccgatattgcataacagaataaaagcaaagacaaacgccatcaggaaattgaataccggaccggcggcaaccacactgatgcgcgcccagactgattttttcccgaacgccctgccgtcctcgctctccgtatcctctccctccatcatgcacgctccaccgatcgggaacagatgcagggagtatgtcgtctctccctttgtgatgccaaacactttcggtcccagcccgagacagaattcattcacccggattccgtttgccttcgccagaaggaaatgccccagttcatgaaaaataataatcagactgaatatcagaattgcgataataatcttcatgcaaaaacctttccccatttgcctgcaatgtgttcatatgcggctgcctccgtctccaggatctcatcaaccgtcggattggcaataaaatcagctgcctccatacacgattcaatcatctccgggatctgctgataggcaatttttcgatccaggaaaagcgctaccgccttttcattcgccgcattaaatgccgtcggaatattgccgccgcggcgcatcgcctgataggctaacgcaagaccgcggaacgtctccgtgtccggtctctcaaacgtcagctgtcccaatgcaaacagatccagtctgtcgcccgagagcggtctgcgcttcggataatagagcgcatactggatcggcagacgcatatccggtgtgccgagctgcgcaatgactgcgccgtcctcatactgcaccgcggagtggatcacactctgcggatggacaaccacctcaatctgctccagctccacatcaaacagccactttgcctccatgacttccaggcctttattgacaagcgttgacgaatcgatcgtgatcttgcgtcccattgtccagttcggatgacgcagcgcatcccccacctgaatgtgcgccagatcttccggctttttcccgcggaacggtccgccggacgccgtgagaagaatcttcgcaatgcggttcccgttttctccctgcagcgactggaaaatagcactgtgctcgctgtcgaccggcagaatcggcacgccgcatttttttgccagcggcataatgatatgacctgccgtcacaagcgtctccttgttcgcaagtgcaatctttttccccgcttcaatggctgcaatcgtcggtcttatgccgagcatcccgacaatcgccgtcacaaggatctcactctccggctgtaccgccacctccagaagtccatccatgccggacaccacgcggatattcagatccttcgtgcgatcgcgcagttctttggcggcgtccttctgaaaaacgcataccagcagcggatgaaactctctcatctgctcttccagctttttgatgttgcttccggccgcaatcgccgtcacctgtatgtcgccctgctcccgcacaatatctaacgtctgtgtcccaatggagcctgtcgatcccaaaatagctatcttcatcataggtctctcccaaaattacaatacaatcaaattagcggcaaggaaatagatgagcggcgccgtaaaaatgacgctgtcgaaacgatccaggataccgccgtgtcccggaatgagttttccataatccttgatgccgtaattacgcttgatggcggaagctgtcagatctcccaccatggataccagtgcgcccgccgcactgatggctgccataatccagacatgtgacatctcacttcccatcgccccgcgaaataccatgccgtaaatcacggtgagaagcgcagctccgatcacaccacccacggcgccctccacggactttttcggactcagcttcggcgtcatcttatgcttcccgatcagcatgccgacacagtacgcgcaggtgtcgcatccccaggaacacagaaaaataagccacacaatgtaggttccggcgctaagcattctggtctggtacacgtaggacaacatcactgccacatagaacacgccgaaaaatgcggcgagcagctgctccgtctgatacttcgggtaagtgaacacatacacgaacatcaatacgatcagaagccctaaaaccagcatcatcagatccggcagaaagccgaagcgcagattcgcatagtagaccgccgcagccgcatacccgacaatgcccggtgcagacttctcaatatgaaaaatccggtataattcaaacatcccgatccaggaaatcagcaacgtggacaccagcagcacatccccgccggtaataatcaataccaatgcggcaatcacaagaacgattccgctcaataatctcgtcttaaacatatctcctccatccggcagtccttcctatttcttgtctgtcaaaccgccaaatcttctgtctcttttattatacgcttcaatggcacgctctaattcctctttgtgaaaatccggccacggcacatcggtaaagtaaaattcactgtacgccagctgccagagcaggaaattggacaacctgagttccccgctcgtgcggattaaaagatccggatccggaatgcctgcggtatccagatactcctcaaacacactttccgtgatctcttccggctttctcttccccgccgcaacatcttcgctcatacggcgcattgcgcgtgtcatctcgtcgcggctgccgtaattgatggcaatctgaagattcaagccgtcattttttgcggaggcagcctccagttcacggatgcgctcctgaaagcgctcactgagtctcgtcgtatcgccgatcacgcgcacgcgcatattgtttttgtctgctgtcttaatgcagttcttcagatagctttccaaaagcttcatcagcgcttccacttcgccctccgggcggttccagttttccgtcgaaaatgcgtacatggtaacatactttacaccgagatcatgtgccgcctggcataccgtctcgacattcttggctcccgctgtgtgtccgtaattccggggcattccctttgcttttgcccatcttccgtttccatccagtatgatcgctatatgctgtggaatctttcttcccgtctccatacctgtgcttctccctcgtatctgtactgaagtatcaactatacaaaataacggaaaagatacagatgtatgcctccataaacacctgtatctcctctcgtttcaaatctatccaaactatacggtaaggatttcctttgtctttgcctcaacggcacgatccacatctgcgatgtacttatcggtcatcttctgtgcctgatcttccagctgcttgatctcatcctcggagacatcctccttggcaagctttttaaaggaatcattggcatcacggcggatattgcggattgcaaccttcgcattttcgccctttttctttacatcctttgcaagttccttacgtctctcctcggtaagctccgggaacagaagacggactgtctttccatcattcgtaggattgattccaagatcggaagtaaggatcgccttctcaatctcctttaccatggatgcctcccacggctgaatctgaatcatacgcggctccggaacactgacattcgccacctgctgaattgctgtcggagtaccgtagtaatccactctcaacttgtcaagcacatgcggattggcgcgtcccgcgcggattccgccgaactcctccgcaagattgttcattgttttgcccatcttttcatcaaataccgctaatctctgatccatatatataccatgcctttctatcaattctaagaaaccgtaaccttcgtgccgctaaactctcccgtcatggcttttacgatactattctcttcattcagtccgaatacatacatcggcatccggttctccatacacataatggaggctgtcagatccaccaccgcaagcttcttgtcaattacttcctgaatagagacttcatcatacttcactgcattcgaattcagcttcggatcactgtcatacacgccgtcaatcgcttttgcgaggtagattccgtccgcctccatctcaatcgcacgcagaacaattcccgtatctgtcgaaaagtatggatgacccgttccccctgcaaaaaacacaaccattccctttgcaaaatacttattcgcacgatccttggaaaacagctttgtcatgcttccacactcaaaaggtgtcagaatctgtgtctgcatgcccacagagcggaaaatctctgaaacatagatgcagttcatgatcgttgcaagcatgccgatctgatccgctttggtgcggtcgatcgtctcgctggtgcgtcctctccagaagttgccgccgccgatcacgatgcctacttcggtaccaccatccacaatctgctttacctgttttgcaacctctgtgactgtcggctcgtcaaatcctgtgtgtttatcacctgcaagcgcctcaccacttaactttaacagaactctcttcatgatgcttagtttcctttcttggcattgaacaggctctgaacatccacatctgcatagcactgggagcagaatccctcaataacagcgccgttgttgatctgaacagaacgggacttgatgttacccataaccactgcggaagtatccacaacaaccggtccctgcacatcgatgtcacccttgatggctcctgcgatcactgccgagttggatgttacattacctataattacagaaccaagaccaatcttaaccgtaccggagcttacgacttcaccctctacctgtgcagaatccgcgaagaattcggaagtgttgctgttaccattgacaacacctgtcacggtaagctttccgttgcagcttacatttccgtctacctgacctctgatgtcgagagatccgtttgagatcacatcaccattgataatcgttccctctgtaatcacggaaacctcgtccgatacaatcggcttctcctgcggtgtggtctgcgatgctgctgcctgtgctcctgtctgtgctacctgtactggtgttactgtattatcagccattttcttctcctcctgtgctgctgccattgcatgctgtgtgtattcttctcttgttttctgtggttccaccgttgctgcctgtgtccgctccaaagccggctcctgcttcgttacctgctctaacagaccatccagcttcgacaattcgctcgccacatccacttcatcttccagtgtgttcacgaccatgtcatcatccttgtccgtgctttcgagattgtcttctcccggcataagttcattcactgcctgtgagaaatcatccttaaagtccttgaaaaatcccatgttcttacctccatttataatctggtcatctggcactgtcggctttgacatactggataacctgtgtatcttcatcaatcggtaaaatctcggcatccatatcctgcaatgcctcgatcagcggtcctaccgcttctaccgttgttgacttatcttccgagtcgtgcaaaagcacaaccgaggtcttgtattttgaaacatctgaaacaacattctcgaccagttcttccgatgtatatgcagcatttgccgcatcgcctgccgagatgttccagtcgtaataaacgacgtcctcgctgtttaaaaaccggatcagcgaactcatcggcacattgctgatctgattgctgctcccgcccgggaaccggtaatagcggctcttttcaccggtcacctcatagagataatcctgcagctgatgaaaatccgcctcaaacgcatcctccgactgatagatcagactgtacttattagaataggaatgcattcccagcgtatgcccctcatccacgatcctctggtagatggctgccgatgcctcatcctcttttccgaccacaaaaaaggttgccttgacatcgtactccgacagcacatctaaaatggcgtccgtattctcagacggcccgtcatcaaacgtcagataaactttatgtacatctccatcctgtgccagattgtctgtctcgtcgatcccggatgcaggtgccgtcacagccactgtctccgtatccatgccgccggtctcttcctggggtagtgcctccgtatccggcacctgctggttcatcacccgctgcatctgccagagttcatctaactttctctccatggatctcgtccggacaagcagaaaaatgatcagaatcatggacaggatgatccacccggcaattatcgcgattatggtatgtttcattcttgcaatccgctttctccgcctgcgttgattgcggagtgcctcagaatccttatcctgcatgtagaacccccaagttaatcataatactttatctattgtatcacatttttgtatttttcaaagaaaaaagcgcaaaaaaatcgtatgatttttctacactttttcatgtattttctgaatttttatgtttctccagctaaaagcccggtgaccaccgcccccacactaaacagcatcacgccccaggcgatgacagccggcgatgtcccgcgcagcgggattttccctaatatggcaaccggggacgccgccagcagcccgaaaattgcccagtaggtcagcctctcaaaccggcagagcagatattccatcagctttgcgacaagaaaaatacctccaagcacgccgcatccgaacgggactaatagggcaagacagtaccacgccgtcccggcatccagcatgaccaccgccacaacgaacgcattgatatggtcaatgaccggcgtgtaatatccgagcgccatcaaaagcatcgaaccgctcacccccggaatgaccatcgtagccgcggcagccagccccaccgcaaaaagcttcactgccgtcccaggaccggcggcaagaacctgttcgctgccttttccaaggaactgcattccaatcatcaggcagaagaatcccaaaaacagcgccagctccggcaccttcggatatcccctggacaccttgcgccagatgagcggcacgccgccgaaaatcagtccgataaaaagcatcgcggtctggaacggaaaattctcaaaaagataaccgatcataaaggaaaggcagataattccgatccccattccaaacagatacggaaacagctttaagatgctttcctttttatgacggaaaaatccggtgaccgcctgcagaagttcatcataaatccccagcgacaccatgatcgtaccgccgctcactcctggaactacattggcgattccgatcgtaattcctcttatgacattctttatgaattccatacatcctccacttttttgcatgctgcctttctctgttccgccgcaagcgattcgctcttcttatccggaagaagatgctctgccatccctgccagcagatttccggccggaagcaaaagcagggtcgttccgatattaaaaatcgtatgcatgttggcaatctgggcagccggccgtcccggcgtcagctgcgcaaccagcgaaacgagcggcgttgtcatgcacagcacggtaaacaccaccgttccgatcagattgaacgaaagatgaatgatcgtggtgcgcttggcgtttcttccggtgccgatggcagcaagaaccgccgtaatgcatgtgccgatattctgaccgaacagaacatacaccgcccccgcgaaagatacggctcctccctgtgccagggtctgcaaaatcccgaccgaagccgaggatgactgaatggctgccgtgaacgccgcgcccgccaggattccaagcagtggatgttcaaaccttgtcatcgcccgaaggaacacctgcgaatcacagagcggctgcatggcttcccccatcatatccatgccgataaacaggattccaagccccgccacaatctcgcctgtgtaccggatccggtcttttcccgcaaacagaatcaggaccaccccccaaaaagccagaagcggcgcaacggctcccgcatccagtgcaatcagctgaccggtgattgtggtgccgatattcgcccccatgataatccagaccgcctggcgcagagtcatcatcccggaattcacaaagccaacgaccatgaccgtggtggccgaggacgactggatcactgccgtcacagctgctccgacgcccacgccaaggaagcggttctttgtcagccgctccaggatctgcttcatcttctcacctgcggcagcatttaagccctcgctcatctgatgcattccatacaaaaagagtgcaagccctcccagcagtgcaaaaaaatttctatattccattttcttcttttcccttttcttatcctaatcttatgacgcttctaatacctgtgataaccaaaagggcaaatcttttttaccgtcggaattgtgcacgaatcgtaccatgcggtaacctgccaggcagatgcacgccgccgtgacggtaagcactaccgcctctgcatagggaatctctgctattttgaataaaacagcagtaaaaagatgaaaaaaaagacgctgctccgccgccccggtcatttttctcgtcacgacaatcatactctgtgacaatcctgcttccggttccgccgagagcgcgtttgagacataatcggagtccgtcgtccgtaaaataccctgtgcttcccctccggcctctgccgtcagattctgcacctgggcgatctgtgtctgccacagacagacaccaagatgggaaaacagcagaaccgccatcatgcaaaccgcaaaaaatgcttttcttctatctgcactgcgcatgttccctgctcctttcccattccaagactctttcctcacgatagcaaagcacttacgacttgtcaatagatgcggatatattttccataaacctgcgcagtgtctgttccgttgtcgcaatcgcttcctccggaatgccttcggccagcctgcggaaaaacgcggcttttttctccgttatctgcttcgtgagcacactacattgctgcgtgagatataaatggcagattctcttatcggcagcatcccgttccaccacaagaaactgcttttccacgaggctctccaccgatctggcaaccagtcccttggacaccccctcgtactgcgcaatatcccgcgccgtattgcatccgccgttgtcgcgtgccaaaaaaagaagcaccagcaattcgttcggcgtgagatgatatttctccatctcatcctgaaagtatttccggtatgctttctctatcttaaaataattttcaaaaaagtcctccagcatgttccccctcctttccgccggttcatgccttctctttgttttagttgatttgtgaactgtttatatagaaactttatttgaaatctgtataaaagtcaattaaaaaagtgttaaaatttcagaaaaatcactccgactcggttgactttctacacaacaaccgataaaataatagttgatttgtgaactgtttaactggtaactctattaaccgaatcctagaaagtgtgtgatgttattttgaacaaaaaattaaaagagaaattcgacgaatctgtaagcgccgttcttcccattaccgtcattgtgctgttgctcagcatttttgtcgtaccgatggagaccggaaccattgccctgtttctggtcggagcgttcatgctgatcatcggcatggcatttttccagctgggtgctgagatggcgatgacaccgctcggcgaaggtgtcggttcccatatcatgaagacgaagcgtctttcgattctgattattgtctgctttgtgatgggtgtcatcatcacaatcgcggaaccggatctgcaggttctcgccaatcaggttccttctattccaaacgaaaccttaatctggacggtcgctctcggcgtcggtgtctttctggtcatcgctgttttgcgtatcattttcaagctgagcctccccctgctgctgtgtatcctctatgccgcactatttttgctctcctttgcggcgccggctgatttcatcgcagtcgcatttgactccggcggtgtgacgacaggtccgatgactgttccttttattatggccatcggtgttggtctctcctccacgcgaagtgacaaggacggttcgagcgacagtttcggtctgatctccttctgcagcatcggaccgattgccatggtactcctgctcggtattttctaccatccagccggtgcatcctacaatgccaccgaaataccggatgttgtgaccatgcaggatgtcatgcgtcagtttgtacatatgctgccgggctatggcagggaagtcatttcttccatccttccggtactgatcgtctttttactgtttcagctcatttccaggcgctaccacaagaaccagatgatcaagatgcttatgggctttctctacaccatcatcggactgatcctgtttctgaccggtgtcaacgtaggatttgctcccgtcggaagtctgctcggcagcaatctcgccgcacagacatggcgctttgttctgattcccatcggcgcgttaatcggttattatattgtaaaagccgagcctgccgtgcaggtgctcaacaagcaggtggaggatgtgacaaacggttccatttcgcgcagtgcgatgaacctctgtctctccatcggtgtctccgcttccgttgcgctggcgctgctccgggttctgaccggacttaacatttactggctcttaattccgggctacatcattgctctggtgctcacccggtttgttccaaaagtatttgtcggtatcgctttcgactccggcggtgttgccagcggtcccatgacctccacgtttcttcttccgcttgccatgggcgcatgtaccgccgtgggcggcaatgtggtaaccgatgcgttcggcgtcgtggcgatggtcgcaatggcaccgttaattgccattcagatcatgggcgtactgtatcagctgaagcttaagagggcgacatccgatgcgcttatcatgatcgatgtcgacgacaatgccattatggatattgaggaggaataattatgcaggatcataccatgcaacataaaaaaaagatgccggcattccggtgcctcgtcattatcatagattccaatatccgtgataaactgaccgaatttctcaccgatgcctccatcccgatctattaccagatgcacggcgtcggcaccgtcagttccgattttctgaatctgtgcggtctcggcgacaccaacaaaaccatcatgctatgcatcgtcccgaaggaacgcacccgtatgctgttggcggagatgaatcaggcgctgcagcttcacaagagaggaaccggtatcgctgtcagcataccgttatccggcattcagggatggctctataaagttctcggttccggttctttggactcctctgagccggagatagaaaaagaggtgaaaaaaatgagtgaaacgattacacatgcaatgattcttgtcacaatcaatcagggatacagcgatgatgtcatgtacaccgcgcgcgctgccggcgctaccggcggaacgatcttaaagggtctgcgctgcagtccggaggaggttgccaaacatttcggcatggctctccaggaggaacaggaagtccttgccatcgtcgttccaaaggataaaaagaccgaaatcatgaccgccatcagcaagcagcacggcattgacacaccggcgcacggcgtcagctttgccctgccggtcgacgcgatcatgggactgtagaatttatactttatgacgcaaaaaccttatcgaatcataaccaggttcgataaggttttttcttacaaaatgacccctgcaaatagtgtctccaccattcgtaggggtcattatccttcaacaatttagcacaatatcaaattatgcgttcatctgtgctgcaacttctgctgcaaagtcttcctgcttcttctcaagaccttcgccagtctcaaaacgaacaaatctcttaaccttcacagtaccgccaactgccttggatacttcctcaagatacttggcaacggtctgcttgccgtcctcagccttaacgtaaacctgatctaccaggcatacttccttgagttctttgctgatacgtccttcgatcattccgttgattaccttctccggcttctgggactccttcggatcgttcatgatctgtgctaagaggatctctttctcatgagcgatgtaatcagcacttacctcgtctctggaaacatacttcggattgagtgctgcgatctgcattgcgatattgtgcattgcttcctttacagtgtcatttacaacatcggtgtctgcatcaacgataacgccgattcttccgccgccgtgtacatacggtacaacacagccatgctcagctacaaccttctcaaatctgcggatctttaagttctcgccgatcactgcaaccttctcaaccagtgcttcacttacggtcttgctggcatcctcattccacttctcagccatgaaagcatccatgtctgctgcatcggaattcactgcctgtgttgcaacagccttaacaaactcctggaatgttgcattctttgcaacgaagtctgtctcagagtttacctcaacaaccgctgctgtctggtcatccttggtcactaccatgcaaagaccctctgctgcgattctgcttgccttcttctcagccttagcctgtccgttctttcttaagaactctacagcctcgtccatgttaccgtttgtctcatttaatgccttcttgcaatccatcatgcctgcgccggtcatctcacgcagttcctttaccatagctgctgtaattgccattttctcatcctccaaaaaataatttatcctgattctttatctttatgccacagaaagggacgtaacacgcgtccctttccgattgttgacatatgggcgatcctgccaatcaggcacccgttgtttccaacttattatgcttcctctgctgcatctgcctctgcggactcagcctcttctgcagtcatctctgcaccctggtttgcctcgatcactgcgtctgccatcttggaaacgatcagttttacggctctgatagcatcatcattgcccgggatcacataatcaagttcctcaggatcacagtttgtatctgcaataccgatcagggtaattcctaatgtatgagcctcctgaatacagattctctccttcttcgggtctacaacgaagattgcatccgggagcttcttcatctccttgataccgccaaggttcttctctaacttctcccactctttcttaagtgcgataacttccttcttcggcagtacctcgaatgtaccgtcggttgccattgtctcgatctcttttaatcttgcaatacggctctggatggtcttgaagttggtaagcataccacctaaccatctctcatttacatagaacatgccgcagcgctctgcttcggtcttgattgcatcctgtgcctgcttcttggtacctacgaaaagaatggtgccgccctcagctgcaatatcagatactgctttgtaagcctcgtctaccttgcctacagatttctgtaagtcgatgatgtagataccatttctctctgtgtagatgtacggagccattttaggattccatcttctggtctgatgtccgaagtgaacacctgcttcaagtaactgtttcattgaaataacgctcattttcttacctccatggttgaaatcttccatatgcttcatcccgcaaggcaaccattcggcaccggcccggtggtcagcatatgtgtattattgtgtggaaatgattttccacgcttgaacctcgcatattatatcacaaacatctttgctgtgcaagtacctttttactcttcaagcggtcccgcctgcagaatttttgcaatttcctcattcgacagaccgtaaggaatatcgtagttgccgacacgcatattggaagcgtagccgatctgcgataaatactgccggaacgtctccgcatcggaaatgactccgttctccgccagcttctcgcagacaatacggcagacatcccctttctgaatcaccagacggtatacgccggacggattctctgcatcagcagcctcctgctgtgcctgcgtctcctcatccgtgttcgcgctattctcctgcgcctcagctgccacgtcctcagctgcagcttccgtattctgcgcggtctcttctgccgcggtccgttcttccaacagttcggatgccgtctgctcggtcacaacctccgtcttcgctccggtgtccgtgccgtccggatcctgctccgtatcgccctgctctgttgtctctgtctcctgcatgaccatgccaagctgtgccgcccgcgccatgatctcctcatcagacatcttgatctctttctttgaaaaactgactgccagtatcaccgttgtgacaatgattccgatccccagtccccgcaaataatatttcagtttcacgaatcactctctcctctgtaaagcccattgaccaggcgaacttcaccgattccgattccaagcttcttggcaatctgaacctccgtcattccgagttttttcaacttcagaatctctgcatgcagtccttcctgctttgtctcttccgtctccggcatctcttccttctgctctgccggtgcagcagccgtatctctctccgtcgtatctgccgtctcaaccggtaccggtgttactgccgagaccgcagataccgctgcggcacgctccggtgcagcctgcggtgcagtcaaaggtgctttctcctcaaggcttcttacatccgcagccaggcgctgcagatccgccgccataccggtaagctccgtgtgtttatcgttcagcatactgtataagaacataatctcattatgcgttttattcatgctctcgatcaccgtgtcggaatattcactgatcgccatgatcttatcgtttgtcactttttcaagggaacgatccaccttttcggaagactggtcaacctgctcatcaatcgcatcctcaatccgtgtctccgcattcttgagtccccggtcaatgattctctttaattcctcttcgctcaactctgcaatctggttcaattctgacggcgataacttttccgtcacaaaaaagcttccgatcataaaaaccacaccgatcagaagtaatatccatgctactccggtcatatgcttctcctcacctatctatatcttgatatcaaaatggctgccctgcccttttaatatgacttttccctcattctcaggctcctcttcgcggcgctttttgtgcctgccagattcgccctcatattcgttattgcccttttccttggcatcataacgatagccatcgttctccttttcctccggatcctgcacacgatgggtcagctggtcttcgtgcttctgctgttcaatctgaatattctgctgttcgacaatcggcctattatcctcctgctgcttcagattcccgacatcctgcgtcctctgaatcatcccgtttaaaacaactggtcttattgacatgcaacacacctccgctcatctgctactcagtcagaattcccatatagcttcccatctttttgcgcatcttaagcagcgcctttgtgtgaagctgcgacacacgcgattcagacacttccaatatattgctgatctcctttaacgtgagttcttcataataatacagaagaatcaccttgcgctctttttccgtgagcagatccattgtctcggacagaacttttttcagttcttcctcctcaatattgtcctccggctgtgcgaaatgggagttcccgcgcgcatccatcaccggctctccgccctgctccacgaactcattgagagataccacgtttgtgacttttaactgcgactgccactcattcagttcagccgccgcaattccaatctcccctgcaatctcttcatccgccgcagcacgtcccgtccgcgcctcgatatttttgattgcttcctcaatccgcttctgcttctgtctgacagtccttggtatccagtccatcttgcggatctgatccagaatggaaccgcggatacgcaggctcgcatatgtctcaaactttacgtcttttccgggatcaaacttatcaatggcatcgataagtccgaatattccataactaaccagatcttcgtattccacattgtatccaagatacatgctgagccggcccgcaaccactttcacaagcggtgcatattccgtaatcagcttttctctcagcgcagacgatggatttttctggtattctccccatagtttttctctgtcaaccgttttcattggaagcccccacgtctaaagattactgttctttcgcatcggcattctctgtctcctccgatgccgtttcattctcttctgcctcaggatcctcttcttcctgcggcaatgtaccatccgtggtttcctcgtcattcatcccggcaaaattgcggtcaagaacaattttgaccacaccgcccagaaggtaaaatacaatcaggacaatcaaaagcattttcatgaaatctgccacttccatgtgtgcacagatgcccgctacgcaggcgacaaacccggctgacagcatcacaatcgcaggtactgattttgttttcatacttacagcccttccttaaataatcttaagcggcttgcccaccgacttaatataaaattctccggtatcacaatgcagttccactgttctaccataattgagtcctgtatcttccgctaccagccggattccaagttcttttaaaatcgctttggcagcctccgcattcctcgctccgatatttcccacatccgaaagtccgcttacctcaaacatccgcgcgcccccggcaatcttggcgatcagtcttggcttacttgctcccgctgcaacaacacgctttaacaattcccgaattcccgtatctccaaacttagctatattgctgttgtttcttacttttgtactgtcaggaagcatataatgcaccatgcctcccacttttgtcaccggatcataaagaaccagtccaatacaggaaccgagacctaaagtcgtaattacatccggagccttgcaaacgttcaggtccgccatgcctacttttatgacttcgctcatatacgcattctccttatattgagataccaagtgacgttaatattttttcgtaagaatcctgctccggcatcaagatgaaatatccgttgatcgccacatccgcacagatctccgtctgtatcaacaatgcattgtcaccgtactgtccaaattcaatcgccggcacgctcaaaatcgatgctgccatgtccaccgcgatgtatggaacggacggagtgatgacaagattggtcagggaggacaatgcggacagataagatcccgcaatgatattgccgatctcttttaatgcggaaagttccatctcgccaaacggctggtcatccggttcgtttgtcatcatcagcttgttgaccagataacgtgcagacggaatatccagaaggaacatcatgcttccctcaatatctgtctccacctcaaggaaaatgccgacaattgtctcatcttccgctcctaccgccattcccaactgtgatacttccatcagccggatgctcggtacattcatatcgatcttcatgccaagcatatttgcaatggctgaagtggcatttcctgctccgatattgccgatttcacgcaatacgtccaggtacatgtcattcacttgctctagtgtcatattacccatgaacgttttttctcctctcaacataatatatccatggttttctaagaggaatgtctctggttctctcccgctgcattccctgtagtaaaacaagcaggttagcggaatgtattccattccgctaacctgcgcacacgtctatgcacgcatatgttctgtgtgcttatgcgttgtcatccaccaccgagttaatctcgagaagtgagatcagatcatcgccgtgtttaccgattccattgatgaatttacccttgttggtcgatttttcaatttcatcctcacttaaattgacgacttccttcacctcgtcgacaatcacgccgatcgcgcctttttcttccagctttaagatgatgatacggctcgcgttcgtgaacacatcatcctccagccccatcttgttgcggatactcattacggatacgatctcaccgcgcagattgatcacgcccttaaagtaggactggatcttcgggacacgggtaatcttctgcatacgcacgatgttgtcaatatagctgatatcaattccgtactgctcgcttccgaccattacgacaatatactgttttgactctttgtcaattacttccacgttcttttctgccatgttgtccgcctcctcttacatcagtacattcacatcaaggatcagtgccacttcaccatcgccaaggatcgttgcgccgctgatgatcttgttgttgtttatgtatttaccaagtgacttgataacgatttcctgctgtccgatcaggttgtcgaccacaaggcctgccagattctcgcccttctgtacaatcacaaccgtcaggctctccggctcttcttctttcggctcaatatccagaacctgatccatacggatcagcggaattaccttgccgcggaggtgaatcacttcctgagcctccacatacttgatatccttcaccggaatatcctcgatgttggaaatggaaccaagtgcgattgcgtatttctcatcgcggatctctaccatgagtgcctggatgattgcaagtgtcagcggcaggcgtacggtaaaggtcgttcccacaccgagctctgtctttacttccacatcgccgccgagagcctcgatgttggattttacaacgtcaagtcctacgccacgtccggaaatatcggtaatcttcttcgccatggaaaagctcggcagaaacagcagattgatgatctctttctggctcattgtctcagcctgctcctcagtgatgacaccgcgctcgattgccttgttgcgcacagcctccacatcgattccgttaccgtcatcgccaacctggatgatgacattgttgccttcctggaatgcgttgaggaaaatgcttccgacttccggcttgccctttgcaatacgggttgcgttgtcttcaagtccgtgatccgcggaattacgaagcagatgctgcagcgggtcaccgatctgatcgactacggtacggtcaagttctgtatcttcacctgtcatgtacaattccatcttcttgtccagctttctggaaagatcacggatcatacgcgggaattttgcaactacactctcgattggcaccatccggactttcatcacggactcatgaagattggtcgtgatacgctccagatattcaatctgctcatggaaggactggttctggaaatctccggaatcggtggagctgatcgacaccagactgttctttgcgatgataagctcggatacctggttcatcaatgcatccagcttctcaatatctacacggacagtacggtttgtgactggctttgcaaccgtctgctttttattgccgctgctctgtgtcttcgctgccggctttgctgcctgtgcctgtggctgctcctgtgccggtgccgcctcagccggtgcatcctgagacttctctgccgccgcagcgtccgcttccgctttctcctgctttgcagccagcgtctcgtattttacttcctcaccgacaaccttatcaatctcagacaccgactttgcagcttccgcaatcttctcatacggctcgtccgacgcaataaaaatgctgaaatcgcagtcgaacttctcatcctcaatatcctgggagctcggattgtatacaaggatctctccaaactcttccactgccttgaataccaggaatgctctcgctgcctttaacaggcactccttctggatatagatggtcatgccgtaaatgtgtgcgccgccctcttccgcctgcttgattttatccttctcggactcgctgagaccgaactcaaaatactttttatcatctccgcccgcggtctgtgccggtgcctcttcttttttcggctccgactgtgcaggtgcagctgctgcgccatcctccgccgcgatgaaatcattcagttccttgatgatcagttcgttgtcctctgttccctcatccgaacttgcctttacgttgtcgagatagccctcgatcgcatccaggcacttgaacagaaggtcaatcatagaactggtcactttgactttctcactgcggacctcctggaacacattctccatgtcatgtgtcaggcgctgcattctcttaaagcccatggttccagccattccctttaaggagtgtgctgcacggaaaatctcgttgatcgtgtccatgttctccggatctttttccagctccatgatgcagtcacttaaattctgtaaatgttcacttgtctcatcaataaaaatctcaaggtattggcttacatccatattactttacccccacattcttaataattgatttagctacgtcattaagaggaaccacttcatccacaacgcccgcctcggcaaccgccttcggcattccgtataccacgcacgatgcggcgtcctgtgcgatcacatagaccggcttcttcctggcaagggaaacaatccccttggtgccgtccgcacccattccggtgagaaccacgcatacaacctgatcgtaaccgcagtcccgcagggaatcgtacgtgatgttggcacacggcttcaagccgccgatcgcaggcatatcgttcaaccggatcctgtgacttccatccggctggcgcttcacttccatgtgcttgccgcccggtgcgatgtacaccgttcctttcatcagcacatctccgtcttccgcctccttgacatgaatcgggctgacctcgtccagtctgtctgccattgacttggtaaatccggcaggcatatgctgaaccagtaccatcggtgcgtccagattcttcggcagatacggaatgacactctgcagcgccttcggaccgcccgtcgaacatgcaagcgcaacgatcttgctgccactcttgatcgcatgtccggctgttgcaaccggctttgcggtccccgcaggagccgatacagccttggtctgcggtgtgatgcgccgttcacgattgtaactctgggtcgcgcataccgccgagagcacgccgagaagctgttttttgaactcctcgccctttgcctcaataacattggttggcttcgtgacaaaatcgactgccccgcgctccatcgcccggatcgtgacatccgcatccttggttgtcgtcgtacttaccatgatgaccgttgcacggattctgtccttctgtaactgttccaaaagctgcagtccgtccatgcggggcatattgacatcgagaacaacgccatcatagcgcgtcgtcttaagcttctcatatgcctcaagaccgtcacagcaagtatctgtgacctgaaatgttccgtctgaattgattatatcacacatgacccttctcatgagtgcagagtcatcaacaattaaaatctttttactcatatcttatgctctacccctttgacgcgctttgcgttcttcttcaaagatgaaccggatgatttcctcccttacactgctgtcggtaatcaggaatttggctctggcctcgtagggcgtttccggcgttttttctgtcttgatacaggaaataattgttccaatgatataatattgtttgtctaaattttcattctgcagatgtatctcaaagagaacatactgattctcccgaagcttctgatccgtccgaaaccggataccgccgccgcttagatccacgatccttccggcatattcccggtctctgctctttccctccgcttcctgcagttcaataaatagggcttctcccgtctttaatgcggcttcctgttcctcaatggtgtaataattcatgtccataatacatggaaaccggaagaattctcttctctgatacttggagatctgggattttaattcgatctctaacatgtatacattctctcttttgtagcgctcccgcacctggccgacggcgcggtaaagcgttcccttcgagaaaaagataaactccatccggatgcccagcggaagcagcaccagttttcctctctccaccggcatggaaatctcaagattgccgttctcctttaaatccagcacctggcttttgtagattttcggcatggactggtctttttttgcccgttccacattctgtacgaaactgatgtcaactttatctcccggttgaataatttcagctattgtcatcattccactccttcattcttctgtttccaaaatcccgaaaacaatcttgacagtccaaaagaacgatatgcgtcactgctctcaccctgcagcaattccgcagccactacttcaaatgctcttgcagattttgacaacggtgcctgaagcgatactggtttctgcatccggatcgccttttcaagcgcgctatcctggggaatcatccccgcatatgtaatttccccctctaagaactgacctaccacagtattcagtttgtcataaactcctctgccttccgcagcagatatcacacggttggaaagaaccgatatcttggtgtactccctgtcaaacttcggattccggtacagagactttaacagagaataagaatctgtcagtgatgtcggctccggtgttgtgaccacaagaacctccgggcttgccagcacgaactccagtacatgattggcaatccccgcgccggtgtccaccagaatcacatctgccatctgatccagttccccgaaacagtgaagcagataagagatctgttcatcggtcagattgcccagtccggtaactccggttccccccgagacaaacccgattcccatcggaccttccgatatgatctccgtgatctgttttccatgatatatcacatctgccagattgtacttgggaatggcgccaaacattacttcgacattggcaaggccaaaatccgcatcaaaaacaagcaccctttttcccatcttctgcatctgcaccgcaaggttcacagccacattcgactttccaacgccaccttttccacttgtgacggtaatgactctggcatccggcttataattttgtttttttaatttcacaacacttctaagcttctctgcctgatccatgtgttatctgcctcccagcagctgtttcacaatcttttgtgtatcaaatacttcaatatcatctggtacattctgaccgctcgtcatataggataactttgcccccgaatacagcttgatatttaaaatattaccataagtaattgtctcatccagctttgtaaaaatcaacttataatttgctatttccttgtaagtatctgcgatctccagcagatccttatatttggtcgtcgcactgagcacgaggtatacctctttctcgtaagcctcatccagtccgtcgatcagctttttcatatcctggcactgtgcctcattgcggtgcgagaatcccgccgtgtcaacaaataccagatcatattcgctcacgcgcgcaatggcatcgttcatctcctccggcgtatagataatgctcatcggagcatccagaatatttgcgtagatgcgcagctgctctgtcgcggcaatccggtaggtgtccgcagtcagaaatgccactttcttctctttgtctaccttatagcgtgacgcaatcttggcaagcgttgttgtctttcccacgccggtcggtccgatgaaaaaaatcaccttcggctttttgcctgtaagctcaatcgtctgcggctgatcgaactttaagatcagcttctgataaacgttggaaagaatagaatccacactgcttccgttgtgaagcaccttctccgcctcgtccatgatctgattgacatacttctcattcacatcattctccagcagcgtgcggtagagcatcttgataaactggaacccttccgtgcggttctccttttcctgcggctctaccggatgagacttgcgcatctcctccacggaaaactgcttttccagaatattcgacaggttctccagccgcttttccagtccctcattcgtagattcgcgctttgcttctttcataggaacaacctcctgttccgccggtgccggtgccactgccggtctggtgttctctcttgccacccccggaatggtaatcttttcatctgcagccagactgatcgtatcgtgcacaggctttgtctcgctgcggagcgtctgcgccgggaacgcttccttttcctccaccgcagccgtcacctcatacagcgtgttcttaaacatcttaaacatgcccttgggcttaatctccttcacgttcagcacgaccgcccccgcgcccagctcctgctttgccttctcgacggcctcttcctttgtcttgccctgatatttgttaatggtcatttatattgtcaccatccctactgattgtaattctacgttggattccacctcattgtaagacagcaccgtcagatccttgaagtaatcctcggtcagcttcttaaagtacatacgcacaatcggcgatgtcataatgatggcaggcttgcccatgttctccaacttcgccacttcctcctcaacggatgccataatcgccttcgtgcgctccggatcgagcgtcagatatgccccctgctccgtctgcttgacagaacccatgatctcctgctcgatcttcggatctaccgtgatcacgctggttgtctcattcgccgggaaatatttgctggagatcgcgcgctttaagctctggcgtgcgtactccgtcaacacatcggtatccctagtcgccggcgcatggtctgccagcgtctcaaaaattgtgagcagatctcggatggaaattccctccgagagcagattctgcagaaccttctggatctcgccaagtccaagaagcttcggcaccagttcatccacgagaaccggattgctctccttgaggttattgacaaggttctgtacatcctgtctggtaagcagctctgcgatatgggaacggatcacctcggtcagatgcgtcgcaatgattgacggcggatccaccaccgtatagccaaggctctccgcacgctctctctggctctccgtgatccagattgccggcaggtggaaggacggttcaaacgtcggaattcccgtaatctcctcctccacatatcccggattcatcgccatatagtgatcgaacaggatctctccctcggtcacctgaattcctttgatcttgataatgtactggttcggattcagctgaatgttatcacgcagtcggataatcggcacaaccgtaccaagttccagtgcaatctgtcttcgtatcataaccacgcggtctaagagatctccgccctggttcacatccgcaagcggaataataccgtagccgaattccagctcgatcgggtccacctgaagcagcgacacaacgttctccggcttgcggatctcctccgcctccgtctctgcctggctgacttcctcctcgatattctcaatgccgatgttcttgtccaccattctgcccgctacgataaacgcagcgcccagcgcagcaaacaataccacattcagcggtgtcacagcaccgaggaagatcaacgatccaccgaccagataaagtgccttcggaataccgaacagctgttttaccagaatgttggagaagtctgcattcttggatgccttcgtgacaaggataccggtagaaagtgagatcagcagggacgggatctgggaacagagtccgtcacccatggtgagaagaccatagcgctgaatcgcctccgaaaaatcaagtccaccgcgcatcatccccatcgcggttccaccgattaaattgacaaacgtgataatcagtccggctgtggcatctcccttgacatacttcgtagcaccatccatcgaaccgaagaagcttgcttcttcctgaatcttattacgccgctctctcgcctgtgtctccgtaatggctccggtgtttaagtcagcatcgattgccatctgcttaccgggcatagcatccagtgtaaatcgtgcggatacctctgccactcgctcggaacctttattgataacgacgaactgtatgatgatcaaaatgataaatacgaccgctccgacgatcatatcaccaccgcccacgaagcttccgaatgtttcaacgacgttacccggagcaccggtcgttaagatcagacgtgtcgaggacacgttaagagaaatacggaatatggtagtaaacaacagcaatgtcgggaaaaaagacatatccagaacttccttcacaaacaatgtgttgaacagaacaatcagtgcgatcgagatattcagcgccagcattacatcaagtaacgtagagttaatcggcacaattaaaaagatgactgcagcaagcaaataaagcgcaacacctatgtcagcctttttcatatctcttcctccttcgttttactgtctcatattatataccattgcaagaatctccgctactgcctgatacaattccggcggaatttcattgccgatttcgacattggcgtagagcattcttgcaagcggtttgttttctacaatttcaatgtgattctccctggcagcttcacggatcttctgcgccagataatcttcaccctttgccagaaccaccggtgccttatgcacctccggttcgtacttgatggcaaccgccagatgggtcgggttggtgataaccacatccgctttcgggacatcctgcatcatacggcgcctcgatgcctcgcgcatacgctggcgctgtctgccttttacttccggatttccctctgtatttttgtactcgtccttgacctcctgtttggtcatcttcatctcttcattaaagcggtatttctgatagatgaaatcagcaattccgacaacgagatacaccagactgatcttgagccctgcaccgataatcacatctccacacagtgcgatcgcctgatttaacggaatatcatataaaataaaaaggtcattttcgtgatccttgattgcagtatacgcgatatagagaatcagtgcaatcttaatcagggatttgaacagttcaaaaacggaatccttggagataatccgcttcattccgttcaccggattaaaccggtccagctttggctgcatcggtttcgtggaaaccttccaccccacctgcagaatatttacaagtagcgtcacggcgaatccgaaaataaaaaacggtgccacgattttgagcatctgtatattcaccggtgaaaagaaagacattaccgcataggtggacacatccatcgcattgattccgataaaatccggaatcagattatatacatagtaaaatatctgaagaaatccgtcgccaatcgtggagacaaaaatcttcagcatcagaaacatcacaatcagatcaaaggcggcggtaagctccttgcttttggcgaccttaccgtcctctctggcttctcttaactttttcgcggttgccggttccgtcttttctccgcccggtccatccttcgcaaaccactggaggtgatagggaaggatctgtcttctgtcctgttccaagctaatacattccctctatcatcgatacaatcattcgtttcatttctttaaacacaaaatcggaaattcccggaagcagcattaccgtgaggaacaataccgtaagtcccaggagcaccttcatctgcattccgaccgcaaacatattcatctgcggcgctaccttcgccataatgccgaggatgcagtttagtatcatcatgcaggcaaataccggcagcacaatgcggaacgcgatcacaaaagaatccgccatataggttgtcatggactctgccaggctgtcccattgaaacacctgcccgttgacggggattacctgataggaatcaatgagcgcccgcagtacataatgatgcatgttcgtcacgaccatcatcagaagcagcaggtactgatacagatttcccgtgatggtgacctgcgagttggtcatcggatcgaactcctgcgccatggaaagtccgatatccatgtcaatgatatttcccgcaaataaaataatggaattacaaatgtttgcagcaaatcccatgagcaaccctgtaattccttctcttagaacaatcaccgcatatccaaacatgcccgtgtaggtaaccgctgactgatcgaccgaagggaatatcaggatcgacaaaagaaacgataatccgatcttcactctggacggaacatttttcatgccgaaaaacggagccgcgtacacaaagcaggatatgcgaaccagtattaaaatgagtatttcaaaatccaccaacgaaaacgtataatttaacattcctcaacctaacccagatatatactaaagtctgaccagagcgtattgataaactctgtcagattggttagtatccaggaaccaaatatcatcattccaagaaatacacagacaatctttggcacgaaggtaagcgtctgttcctgaatggacgtcaccgtctgaaaaatactgacgatcagtcccacaaccagagaaataatcagcagcggcgccgagcacaaaataattgtatacaatgcctgtctggcaatgtctaatacctgtccttctgtcatttcacttcatctcctgttccaaatgcacgcatcagtaaaatgtctttacaacgcttccaatcaccagattccagccgtctgccagaataaaaagcagtatcttaaacggcagtgaaatcgttgtcggcggcagcatcatcatacccatggacataagtaccgatgccactaccatatcgattacaataaacgggatataaatgaggaatcccataataaacgcataccgaagttcgctgatgataaatgccgggatcacggttgtcatcggaacatcgtaataaagctccagtgtcatctgatccggataatcttctccatcaatatccataaataggtgcagatccttttcctgtgtctgaccgtacataaagtcgcgaatcggtgtctccgctgccttgtatgcctcctcaatggtaatgtcgccattgtctaacggctgtatggcatcttcgttaatctgctgaaaggtcggccacataataaagaatgtcaaaaacagggcaagaccgacgagaatctgattcggcggtgctgtctgtgtaccgatcgcggtgcgcaggaaatgcagcacgatgatgattctggtataagaagtcatcataatcagaatggacggtgccagtgaaatgatcgtcagcaccagaagtgccttgatcggcgtggatacggctccggtgtcgttgttgtatgtaatggacaggccgttgttgatatcgctcgtcgcatccgtcagtccatcgctgctatcggtattgctcaagccagtaatcatatctgaagatgtatctgccgcatagactctggtctgtcccatggacaacgtcaatgcgatgatcagcactgccaccgcaaagacaaacgacataatacaatatgatttctttaattttgattttgtcataatttaatcctgttttttcgggaaatgttcctttaacttctcaagcgtctcctggaaggtcatctgacctttttctccattctgtccgggagtctttccgttgcagatctctgcctccgtaagtcccatctcttcctcggtaagctttgcgagcatggtcacattatcttttgcaaccgcgatcacaagatacacatctcccatttttattacctgaaccagtttgttgttggcgatccgtatggtatcgaccacctgaaagctgcgtccggacatctggaccttctgatatccgccgatccatttggttgtgaaataggtaatcacaagaacaaacagaaaaataagcaggacgccaagcagctgtataaaactgttcaggcttgaactgagtaaaatcatattagcctactactttttttactgcctcgagcacacgctctgcctggaacggctttacgataaagtcctttgcgccagactggattgcctcgataaccatggcctgctgtcccattgcagagcacatgataatatttgcattcggatcgatctctttgatcttcttcagcgcctgaataccatccatatccggcatggtaatatccatcagaaccagatccggctttgcatccgggtacttctcaactgcaactgctccattctcagcctccgcagcgatctcataaccattcttggttaagatatccttaatcatcattctcataaaagctgcatcatcgcaaatcataatctttgccataacattctctccttgtttcttttcttatattgttttgcttatattgcttttcttatcctgtttccaatcactttacaatctcggtaatacggataccatagctttcctctataataaccacttcacccttggcaacgtatttgccgtttaccagaacatcgatcggttcacccgcaatacgatttaattctataatagttccaggtgcaaaatcaagaatctctttaatagattttgaagttcttcccaattccaccgttacctcaagcggtacatccttgatcagatcaatgttttccggtccgtatcccaccggaacgcttccggtaaacgcctgaaactgtgccggctgtacatttaccggctgctgtccatacatctgtggcatttgctgtgccatcatcggttgtcccatcatctggcctcccatcatcggtgctcccattgccggctgtcccatctgcggtgctgcctgcggctgtggtgccgcctgcggctgtggtgccgcctgtgcttccggagcactacctttgctgcctgcagtcgaattcgtatcttcctccatattctgtgtcacactctcacacatttcctttgcaaaaggaatcggatacagctgcatgatatcactgtcgaccagatcaccgatctccagtctgaaccgtatctttacaaactcgcctgccaggaactcatcgatgacgctctcatcgattgtctcctgtaaatctatcaaatccgcctgtggcgggctgatatcaatcactttgttcagcatggatgacatggacgtcgccgccgaacccatcatctggttcatcgcctcgctgatcgcactcaagtgcagctcgccgagctctccatccgtattggttccatcaccacccatcataagatcagtgattacttttacatcgtgttcctttaaaaccaatatgttgctgccatccagtccgacagtatatccgatccggataaacacacatggcttctcatatgcttcacagatatcactccagtttgcgaaagaaacaactggagtcgagatctctacttttcggtttaccagagaaaacagcgtggtcgctgccgttcccatactgatattggcaatctctccgattgtatctttttctttctcagtcagtacctcttctttgggctgctcgctgctgtcctcagacccgttcagtaatgcattgatctcttcctgagacattactccatccatacttactgctcctctctgattactgatgtcactcttactgcataattatcaccggatgcacccggcagagcagtaaatttttttatatttccaacatacaccgacagatcctgatccactttggtgtcgagacggataatgtctcccacctgcagaccaaggaaatcattgactgatatactactgttacccagcacagccttgatcggcatcggtgcccgtgcaataagtgcctcaatggtctctgtatattgctgttcatccttctcctgcaggctggaataccagtatttcgtattcagcttgtccatcacactttccaatgtgatatacggcaggcagatgttgatcagtccctcgacatcaccaatcttaatatttaacgtaattaacgcgatcatctccgtcggggaaatgatctgggcgtactgcgaatttgtctcaatccgctccagtctcggtgtcagttcacacacactcgcccacggttccaccagaagattcacgcatacgttatagatccgctcaatcagaagaagctcgatttcggagaactccctcgccttgtcaagcggcgccccctggccgccgagcatacgatccacgatcgtaaagccgacattctctgcaatttcaataatgatattgttattcagcggagcaaaatttacaattccaagcagcaccggattcgatagtgcattcgcaaactctgaatacgtcaccgcctccgaactcatcacttccacctgaacattttttcttaggtacaccggcagattcgttgaaagcaatcttccataatgttcaaaaataatctcaagcgttcgcaaatgctcttttgagaacttcgcgggacgggcaaaatcgtaatttttgacctgtttttcattatcatcttttatttcatctacatccagttcaccgctgctaagagctttcagcaaactgtctatctcattttgagataagacttcacccattctctctcaccacctaatgtcttattctagtgtgcttccgttgccacgcttgagaaattcacgcccacgatgtagtcggatccgaacagatcctgcatcttggataaaatctcctcctttacagccttctgtccatcggcgttaaattcctcctcggtatacttggccactaccgtattgatgtcgctgcggataatggtctccttatccgtaagctctgtcatctcgtctcccccgtaggtggcataggactcgcttgtcttgttgacggaaagtcctacagaaaatacagcgtaatgcttctttccatcgccgttgtctgccagattcacggtaaaattatctgtgatattataaactgcaatttcttcgatcggcactgcggaactgtctttgttctgtccgccctcgagttcgatgttgattgcagcgcacacctgatcaatcagttcgtttgactttttggtctgcggaataacggaaaatgccagcaccgcggtcagaatcagattcacgagaaccagtgccaaaataattactgtcaataaatttttcttcattatgcttcccttcctattcgttcacaacttctgtcggttccacagtcgcacctgttgtcgctgcttccggcgtatctgtcaccgtctcagtgcttaaagccgcatccgcaggcgtctctgtacctgtgtcatccgtggatgtcccgctcacattcgagttgtatgagttatagattttaatctcaacccggcggttccttgccctgccctccggcgttgcattatctgcaatcggcacatactctccgcggccagacgactttatgtatgcaggatccagtgttgtggtatcccgcagatagttggcaaccgcaagcgcacggtacatggacagtacgttgttgtcctcatacttggaagaatgaatcggcacattgtccgtgtgtccctcgacctcaatgatgttattatcgtaagtaaccagtatcttgccaagcttgttgaccagcggatacgcctcatctctgagttctgcgctcgcagaatcaaacagcagcgcgccgttcatgttaagcgttacatactctgcattaaaatcaacctcgacgtcgtcctgtatcccatattgcgaaagtgcattttcaagttgctgcgccatatcctcagactcttccagttcctgctgttcatatgcttcggtaatgtctttttcttcctccgtctgtccgtcagactggctgctcagctgctggttgtaataagaatcaaaattctcaagctgactgattccggaagaaatcaattcaccctcgccgatcgatgctccgcctcccgggagtatgctgaatgtactctggaaagaggcaatgaccttctcaaacttttcctcattcacactggacatggagaaaagcattacgaagaaacagagcaggagattcataaggtccgcgaaggtattcatccatgcaggtgagcctttgggtggatcttcctttcttctcgccactattcctcacctccgacactgccctccgcagtttcctctctcgctgaaggtgacaggaatgacttcagtttttcttctatgacacgtggattctctcctgcctgaatcgacagaataccttccaccgtaatttccttcatcatcatctcgttattattgtttacagaaagcttggatgccgtcggattacacagccagttggcaatcaacgaaccgtacagtgttgttaccagtgcgactgccatcttcggtccgatcgttgatgcatcattcatatccttgagcatcaggatcaatccgatcagggtaccgatcataccccaggcaggaccaagttctccccatttttcccagacagcgattgactttttgtgtcgctgctcgatacagcccagatccgtctccatgatacctcttaccagttccggatcggtaccatctaccacaagcatgattccttttttgaggaattcatcctcgattccgtttgccgcctcctcaagtgcaagcagtccctccttgcgggcggtatttgacaaatcaatgatattccggatgactgccgcaggatcctgcggtacctccttaaatgttaatgtaatactcttcagacctgcaataaaatcctgaagtttgttggacgccaatgtacccgatatggaacctcccagtgtgataatgattgaagggaagtcaaacatattgaaaagacccgaagctccaccactggaaaatacaccgaacaaaaacattacaacgccaagcagcatccctgctaaagaagctatatccaattcttccacctaccatccttgatattatagtattgctgtctccaagcggagactgaaatctcaacaagttgtcatcctatatcttgtataattttactaaacttttgaccgcttgtctacttacttttgcaaattctgtgtttcttctttcatggaaccgggattttatcagggagacaaaaccccggttctccaaaatcttatccgtgatgctgctctgtcatctcgcagccgcttatctcttcaggttcacaagctcctcaagaagcgtatcggatgtcgtgattacacgggagttcgcctggaatccacgctgtgtggtaatcatctgcgtaaactcggtggagagatccacgtttgacatctctaactcgccggatgtcatcttgcttccgtccgccgtaatatcctcaccgataccatcgaactcaccggagttcaaggtcgtgctgtagcagttctctccgactttctcaagacctgccgcattggcgaactgtgcgaccgcgatctgtcctaacaggttgcggttaccgttgtcataaataccgtagatctcgccgttgttgctgactgaaagtccgatcaggttaccgagcttcttacctgctccagttgttccgtctgtagcgcctttgctcatcgttacagtggacttgccgccgttgttcgtattctggcaggtgctgaagtccacattgatatttgcgaactgtccgccgaacagggacatgttcagtccaacactcttcgcatccgccacgtttccaacctttgaaaatgttccatcgtccgtgttgaagcttaatctgtgatatacactgttgtatgtaagtgtcagtgccccggttgttccgtcaaccgcatatccggtgccatttccggtgtaagcatccgctttcgccagaatgtccgctcctgcaccgtatacctgtgtcaggctgagtgcccctgctgtgacaaccgtcatgtccgtcgcactttttacctggtcatagctgtgtgtcgctgcattgtactggtagtaattaccgctcttgtccacgatgacgttagcggacacataagtgtaatccttgccgagcgtataactctttgtcgcatcctcggtgttaccgaacagtgcgtttaacgccggctgtcccgcctgaatattctcaggatcgtagtaggtatttccgtcgccgtctaaaacattcaacagctctaccgtgaactctccgtccgttccggttgacttaatggaaaaacgtgcggtgtactcatatcccaggttatcgtagaacttgaggttcttgatcaatccgtcgtcactcaatacgtcggtatcgttcttatcaataataccgccgcaggttgcctcagaggttgcctctggtgcgcttgtcagattctccgtgctcatgacgcgcaacgcggatacggtatctttccggatatttccggttgtcttatctacctgccatcccatgaccgtatatccggtagacgtcatacacaggttgcctgcaccgtctacatagaaagatccggatctggtaaacagattggaagatccgttgttgacaataaagaaattggtggtcgactgatctgtcatacgcagatcgaaagctcttccggttgtctcagctgcacccgcggatgtaatgctgatatttaccgcacctgtggtcacgccaagaccgatctgcttggcattcacaccgccgactcccgtagccgcatttgctcccgatgctccggatgtgttctggtagagcatatcctggaatgtcacggaagaagacttgaatgctactgtgtttacattggcgatattgttaccaataacgtccatttttgtctgatgtgtcttaagacccgacacagcagagtacattgatctcatcataatgaaatgacctcctgtaatgtctggtgccctgctcccttctgtcattcggggagcttctgcctccttgtaaggtccggcatattatacaatcacggcaccgtcaatatttgtaaaaatattactctctgactcactctgatccatggctgtgaccaccgtcttgctcggaacattcacaataaacgccagtgaatccagaatcacgagtgattcccgtattcccttttcgcttgccttcaaaacaccggattccagtctctcgttctgctcgtccgacagattgatgtgtctgtcattcaaacgtccctgtgcatgtttggaaaaccgaagttcctgactttctgcggtcgtctgtttctgtcttaatatatcctcgaaagaaacactgttttcctgcgccgcagtctctgtgcttttgcgattcagataccggtcagttacctgttcgatggaagcaaattggttcgtaatcttattcataaccaacgctcctttctcagatcatccagctttcttctcaagctccgcaatcttagcctcgagtgctgtcagctgatcgtaggaatccttgctgatataagtcttctctgtggtggtcagcgaatcgtaattcttgcgaagtgcttccactgcttccttgttctcaagggtcagctcgtccgcggatggaatctgcgaaagcgcattgtcaaataccaggctcttcatggttccgtccagcttcacaaacgttgccagcgtatcgctgtcaatataactctgctgataagaagtcagtccgttgtacacggttgccaggttctccacatccgtctgatatgccagcgtcagcttatccgcatccggaagctttgccacagatgccttgaatgcctctgccagtgaaaccgcctccatgtactcggtgtctgccacctgatatacatcgtcgagtgaataacggttgccgttgacataaatgtatttctggttgttctcgtactgcacataatccacgaatcctgccaccgccgtcgtctcgccggtcgtctcggatgttgtctttacaatgacatactttccaaccagatcgtttgccttcgtgctctcaatgctgttctgcatgttcagcatggactccatctgtgaaaaagttgccagctgtgccacatactcggtattgctcgtcggttccagcggatcctgatactgcatctctgcacataacagctgcaggaactcgtcatatccgaggtcattgccggcactggtcgttgtctctgtcgtactctctgtaatcttgccgttctctacggcctgtactaatgccatatgtctctcctttctgtctgttatgcggtaaagtcaacggaattgccctgttctgccatcatcttcgccaccagagtctcctcttccgtcatcagcccggacagtccgtccagttcattcaggttgatgtgtctggtcgcattggctgccttttcccgttcctctgcctgctgttcttcctgttttgcattctgctccagattcctctcgaattcatgtccgccgacggttacctccacggcatccacctttacgccagcctggttcatgttctgcttcaaatctgcgatctgactttccagtgcttccttgaccacttcattctgtgcggtcagatgtgcggaaaccgttccgtcttttgacgtaatctccagataaatcttgcccaggtgctccggattcagctgcatctccatcgtcgtttcctgattcgccgtgtaatttactctcgtataagtcacgatctgacgcacgacatctgcgatgtccacctgtgcggcatattctcccgcactattggcgccctgcattgccacggtctctgtcagcgtcgggccggtatgtacatccacgcccacatgtgcctgcgacgcagaattctgctgtccggaattggaatttgatccggtctgtgcctgttccttatccgaccctgcagctgcatcggcagctgtctcttcctctgcgcctgcatttgctgactttgcctgcgtatcagtctcttccggagtgatgtcttttgcttcttctgttctggtctctgtctctgctgcctgggcagccatctgcggctgttctgccgtatcacggattccatccgccgtatcagcgtaaaccttctgcgcatctgtgacatctgtttcaccagcatccgctgtctggactgtctgcatcagatctgcatccatgtccgtctgtccggcatcctccaaaagctgcgtcaattcctcagccgtgactcccagctgctgcaagagatcttcggtcagtgttcccaccgactgcatcacgttcataaacgcttcattacagagaagtgcgctcatgtcttcggttccggttaattctgctgccagagctgcaagctgctgcggattcatcagatcggccacggtcagtcccaatgtctccattgcttctgtgatctgctcgtccgtcacctgaagttcatccttaatgacgtctctcacactctcctcaaagctttccagcttctccgatacctgactgccggctgtccagtccttcgtgctttgctccggcatcttattcttctgatactggtaacggtcataattctgctccggactgtgcggtgtaagctgctgcatattctgcgctgtctgagatcctgtacttacgctgcttcccgggatctgtgtcatctgatcgaccatcttccggaatgtggtgccgatatccgcgccatcaacgcctgtgacactctgtccactctgcgtctgcatcagcattttcccaatgcttgcaacattattgtctcccattctcttcctcctttcccatagctgcacctgcagcctgatttttgaaggaatccctctgccactatgagaagcagactgtccttctctattctacaggttccatgatcgcggtcacctttgctgcagtagccgcgtccattttgcccagaatattcgctctcgattgtgcgtccatgctgtctaagatatctgccaccagctgcagattatctgtcatggtatcaaaaattgcagccgcctcttttggcttcatggaagagtacgctttcacataatcatccatctcgtcgttggctgccgtctgttctacaacctgacggtaaatgatctccgcatccgcaggatcaatgctctcataatactgcttatattcctctatatcgggtgctgaatctgaaaacacaacctcctgatagaacttttgcttctcagcctcaaaatccgcctcgttctgcttgtactgtgccagttctgcggactggctctcaagctgtgcgatatattccgcatttgcgctggacgtattctgtgcatccgcaagttctttctccagttccttgattctggcaaccgcatcgtcaatggaagtatagccgtaagcgtcatcctccgttgacacttcctcagtcgcgctgtccggcaggattttgttcacataaggaacatcctttaacaccggcgccagaacggatgatccgaaaccgccgacatcgcacttgatcaacaggacgatgatggcaagccagattaaaataatgatcagggtaacaaagaacacggcaatcttgccgccagtcgatgtctcgtcatccatatccagatcatcatttaactcttttgcctttttccggtccgctttcttctgtgccttcgcttctgcacgtgcagccttctcctgtgcctttgctgcctttttatctaatacttcgtctttctcttcttctgccatttgagacctccgtgcctatccttcatggtaattgtagctaacaagctcgtctatttccttgctctctgcctgggcgatttcctgcttaaattcttcaaacgcacgctccctgagcttctcatgcgtctttcgctccaccatcacccggttcagttcgattcgcgccatctccagcgtcttttccgcggcgtgcaccttcatcatctgtgctctctgcagactcttcatcacatcgatcgcacgcttgcattcccggatctcctggatatccagcgttccgttgaccagttcttttgattttctctcgtagccggccctgcgcatcaggatctctcgaagcttctcctgctcttccgcaagctgtctgctcgccgtcgcatatgcaatttttgcctgattctccagcttgatcttgatgtcaagaatgttctgcatccggtatgtaaactttgccatacactgcgcctcttttccgcggagcgttcttaatcttcaaatagtttcttcaataaatcgatttcctcgtcaaacaggaacttttcatctgtcctctggcacaggaactgattcactgcgttgatcttctgaaccgcatagtcaatctcacggttggaaccgctcttgtaagctccgatgttgatcagatcctccgcttcgttataagtagccagtacattctttaaacgtccggcaagctccttgtgctcgctggtcgctatggcgctcataacacgggaaatactctgtaaaatatcaatcgccgggtaatgattcttgtgtcccagttttctggaaagcacgatgtgtccgtccaaaatgcttcgggctgtatcggtaatcggctcattaaaatcatcaccgtctactagaacggtgtaaagtcctgtgatggaacccttgtccgaagtaccggcacgttccagaagcttcggcatctccgagtatacactcggcggatatccccttgttacaggcggttctccggacgcgaggccgatctcacgctgtgccatggagaatcgggtcaaagagtccatcatcagcagtacatcttttccctgatccctgaaatattcggcgattgcggtcgccgtcttcgcagccttgttacggatcagtgccggcttatcggaagtcgccaccacgacgacggaacgcttcattccctcttccccgagatccctctcgataaactcgcgcacctcacggccacgctctccgatcagggcaatgacattaatgtccgcttttgtattgcgggcgaacataccgagcagggtgctctttccgacaccggaacccgcaaagattccgatacgctgtccttttcccacggtaatcagcccgtctaccgcctttacgccaagcggaagcacctccgagataatcttacggctcatcggatccggcggatccgcctcgaccggatattcgcatccgccctcaatgactccgccgtcggtcggtcttccgataccgtccagtgtgtgtcccagaacgccgtccccgacaagcaccccaagcggatgtccggtattctcaacgatacatcctaccccgatgccttccacattttcaaacggcatcagcaaaagtctcttatccctgaatccgactacctccgccatcaccgcgtggtctttctctctgtcaatgacaattctgcagagatcgtttaactttgcatccggtccgacagattcaatcgtaagtccgacaatctttacaacctttccaaggcggttgaagtaggtcttttctccaagttgtaaatatttttcaaattgatgtgtcatcattctctcaccttacgaacataaagaccggatatctttgatcagattctcaagctgtgtaccgagactgcagttaaacacgccggaatcggtctctatcgtacagtcatttccctccaccgtcgcgtccgagacaatctcaagctcaatgtcatgtcccacacgatccaggatctcggtcttgtgattctccagaaacagtgcattgtcctccgccaccttcacccggaaccgcttgtcgtcttcaatatttaaaatggcatcttcaatcagatgcatcagtatctcttttttgtcgtcaaactgaatatggaacactttttcaaagacggtaacgatgacatccaccagatcctgttccatatgttcgcgtttgtccctgtaatcgctgtcaagatctccctgctttttcctgtaggactcctcaagctgcacgcgaagctgctcattctcctgctccgccgaagctctgccctcctcgtacccctgcgtctttgcagatgtacggatctcctcggcatcttcgtttgcctgtgccagtatcgcatcggcattctgctgtgccgccgcaaggatctcctcggcttttgcctttgcctttgcctcataatcaatctgcggctccgctttgatgacctgacccggatcacccgtcacaagtccggctgaaaatccgccttcctcttcctgcacattctgtgccggtgtctgtgtctgcggcagatcctgtttcaggtgctgctgcaggatcacattggaatcgatgatgcgcgtgtttgtggaatccgtctgaacaaaccactgtttataaagattagacaacgatctcgtcacctccgcctcttgagattacaatctcgcctgcatcctcgagtttacgaatgacgcttacgatcttctgctgagcctcctcaacatccttcattcgcacaggtcccataaactccatatcttccttgatcatcgcagcaagacgtttggagaggttcttaaatataacattctgtacttcctcgttcgccgccttcaaggcaacgccaaggtctgcattatccacatctcgcagtacacgctggattgcacggtcatcaagcagcagaatatcctcgaatacgaacatcttcttgcggatctcgtctgcaagctccggctcttcgatctcgagagactccatgatatgtttctcggtcgaacggtcgactgcatttaagatgctgacaatagcgtccacgccgccgacgattgtgtaatcctggttgaccagggaagaaagctttctctcaagtacccgctccacttccttgataacatccggcgatgtacgatccatcatcgcgatacgttttgcgacatccgcctgtttttccggcggcagcgcccccagaaccatcgacgcctgcggtgctgtcagataggacagaatcatggcaatggtctgcggatgttcgtcctgaatgaagttcagcagctggcttggatctgtcttgcgcacaaactcgaacggacgcacctgaagggatgctgtcagcttggagataacctcctgtgccttgtccgcgccaagcgccttgtcgagcagttccttcgcataaccgataccgccctccgcaatatactgctgagccagacagatctgatagaactcgtttaagacatcctccttgacctgcggtgaaatacttctggtatttgcgatctcaagggtaagttcctcgatctcgtcctccttaagatgcttaaagatatctgctgaccgctccggtcccagtgtaatcagaagaattgcagctttttgcagtcctgtaaattcctcgttttttgccatattactcccactcctcgttgagccagttgcgcagtaacgatgcagccgcctccggtttttcttctacgaatttttcgatcagtaaacgcgtctcggacttctcattgtagccgatgtcctcaagcggctcctggttctcttttgtggattccagcaggctttccacggaaagttcctcctccatctctgcctgtttctcctttctggtgctgcggaataccacataaccaagcaggagaagaatcagtaccgcaagtatgatctgcagataatccgacagggttcttccaccggaagaatactggaaaatcggctcgtcataagcgatgatgctgatgtttgcctcaggaaaccccgttgcgttggcgatcatcgtgtaattatcctgatccaccgtcgtcttgaccgggtcactgtttgccgcaatatactcgtcaaatgtcatgttatccagcgcaccggatgtcctgagtgtgtcctcatcatagatcacataattttttaccacgatcgcaatggaggaagtatcgtaattgatcgttccggtcgccgccgtgcggtccgtcactttttcattgttctgatactttgtcgtggtatcggtgatcgtggactcggtataattgttatcctcaatcacataggatgtatcgtcattggaatctgtgcccggtgtggcagctgcgccgccgacactgttcgactcataattgctctgctcatcgatcataccgtttgtctgaccgtctggtgccgaatactgtcgctccgtctcgcggtatgcgtcaaaattcatatccagctttgccgccacttccgcatgatcataaagtcccgagccgaccagaacatcctttacctcgctctttagcagattctccgtcttagttctcagagagagagctggctgctcgcggttccgaccgacgaatcagaatctccgcccgaaaaaaggacattggagttcgagtccagaatcagaacgttgtccgtcgtgtcattgccgagctgtgtcgctatgtactgtgccagtccctgtgcctgctcgtcgctcatatctgaattcaaggtaagaattaccgccgcgtaggaatcctgctctctcgcaagaatcgtgccatcatcattcgggatgtccagtgtcacagacgcgctctcgacgtttgacagtgtctccagctgatctgcgaaataattctccagatacagcttgtatttcttggtcttgtccgcctcggtggagctgaatccgccgtcaaacacattgtcaatggaaaatccttccgtcgggacaccgttctgcccaagcagaatcgacgccgccgcattgtccttttcatccacatagaatgtcagcccgtcatccgacatctggtaggagatgcttccgtcattgtccagaaggtcttttacttcacccgcctgcgctgtggaggagcactcgataagcgttaccatgttcggcttcccgacaaccaccgccagaatcaccaatgccagtataattaccgccacaatgcttccgagcaggattctctgcttggttgtaaactttttccaccaatccgttatcttcgttaaaatcttttgcacctgttccggcataatttctaactccattcattaaatctgcatgttcatgatctctttgtatgcatcgagcatcttatctctcactgcaactgtgtactgcagcgcctcatacgccttggctgccgcaatctgcatatcgtgaggattgtccgcctcgcccagcgcgaactggatctttgccgactgcgaatcattctgcagatcattcgtctcgttgagcatattgatcgccgaagacaacaccgagtcaaagctctcatcggtgtccacagacaacagtgtcttctgtgttaccgcactcatgtaatccggtgaagtggcattcgtcaataaactgatatccatctgtatttcccccgtttcatcctaatctatgtcttactgaccgatcttaagtgccgcctgaatcatgctcttgctggcattaaacgccgtcgtgttcgcctcatatgcacgggacgcgtcaatcaggttcgtcatctctgtcaccgtattcacattcggataacgcacatagccgttctcatccgcatccggatgggacggatcatactccattgtaaaatcggtctctgtatcttccttgacggaggtaaccttcacgccgttgcctacagcccgcgctctggatgactgataatatttgctgaacggagtcagatccttttccgcaaacgtcacaatcttgcggcggtacggttcaccgtcctccgtacgcgttgtattgacattggcaatattctccgcgatggtgtcgatgcggaagcgctctgccgtcataccgctcgcactgatgtcaaaagactgaaataatcccatatgctacctcctgtttatttaagcactaatttcatacgattgaattcttcgttgatcgatgtcgtcagcatctcatagcggagctgctccgatgccagttccacctgctccgtatccacatccacattattgcggtccagacgataggaataattggaggaatccgtataggtagacacatctaagcccgaaagatccgagttcagtccccgcactttcttatccagcggaatatacttcgagctgccaagctcccgtttcagcgcagattcaaaatccacatcctgtctcttatagcccggagtatccgcatttgctatgttgttggaaattgccgactcacgtttccagctggcatccgccgccttatccatgatgttaatatagtcgaacgcattcgtagttatcatatgtatcgccctccgcttcacctagtttcccaaactatcttattctattataaaatatggtttcgtaattgcaagagatttttgttattttttacactatcttgtagatttttgcataataagtacaagatattagcaaaattgtcaaataaacccgcataaaaagccacgttccacggaaataaaaaagagcgcacccttcgatacgccctttcgtcctgtttattttttctgattctgctttttgatcttgtcgagttcgtcgaatacaacgtcgttcaatactttgatgtaggttcccttcatgccggaagagcgcgactcaatcacgcctgcactctcgaacttgcgcagtgcattcacaatgacggatcgtgtgatacccacgcggtcggcaatcttgcttgctacaaggattccctccttgccgtccatctcatcaaaaatatgaatgatcgcttccaattccgaaaatgacaacgtgctgattgcagatttgacaatctgaacctttcttgtctcctccgcattctcctcattcacggagcgcatcatttccagaccgaccacggttgtcccgtattcgctcaaaatgatatcgtcaatatcgtactgtctgtcttctctgtagacaaacagcgtgccaagccgctcacccgcaatatcaatcggcgtgatgatcgcagtgtattccttcacgtgatctacgaaacctaacgtctcaagattgacattctccttggtagagaggattccgagcagacgttcgtttagcagcgggtcgatgaaacctcccacctcgtccacgatcaattcctggatctcatccactccgggacacacgcccgttccaagaacctttccctttttgctgatgaccagaatattggatgcaagaatatccttcaacacatcgcagatatcattaaacacgacctttgaagagctgttattgtgcaacagcttattgatttttctggttttgtccaacaattgaacactcatgtccgtgcccccatttcgtttcgaatctctttttcgttatatttcatattttaacacgtcaattctgaaaattcaatattttcgtaatatttgacatatttttttaactattttgtatcctcgtccgcttttctgtcacgggtgtagccgcatcccgcatctgcacaggcgatcttattgccttttaccaccatatagccgccgcacttcgggcacttctccgctaccgggcgtgaccagctcataaaatcgcactccggattattctcgcagccgaaatactttctgcctttcttcgtcttgcggaggacaacgtcttttccgcacttcggacatggcacgccgattttttccagatacggcttcgtgttcctgcactccgggaagcccgggcatgccaggaattttccgtgcggtccgtattttaccaccatgtttcttccgcactggtcgcagacaacatccgtgacctcgtcctcgatcttgactttctgtagctccttctccgccacttccaccgcggcttccagatccggatagaaattccgcacaaccgtcttccagttcacagcgccctctccgatgctgtcgagcagcgactccatattggcggtaaaatgctcatccacgatgctcgggaaggattccttcataatctggttgaccacctctcccagctccgtcacatacagattcttcgcttccttgacaatgtaacgtctgccaagcagcgtcgtgatcgtcggcgagtaggtactcggacgtccgattcccagctcctccagcgtcttgactaaggacgcctccgtgtaatgcgccggcggctgtgtaaaatgctgcttctcatcgaaggtgtccagcgtaagcttcgtatcctcatcgattcctttcagcagaacattgttcgtgtccttctcgtcgtcctcgctcgtgtacacagacataaatccctcaaaggagacctttgatgccgcgacaccaaagcggtactttccggcaccgatcttcacgttcgtcgtctcatataccgcagaagccattctgcttgcggcaaaacgcttccagatcagctgatagaggcggaactggtctctggaaagagattccttgaccaccgccggtgttctcgcaatgtcggaaggacgaatcgcctcatgcgcgtcctggatcttggcgccgcccttctgggtaacggtctgtgtcgctacgaattcttccccgtaattctgtgcgatatacgctctcgcatccgcatccgcctcatccgaaatacggacggaatccgtacgcaggtaggtgatcagaccgaccgttccctgtcccttgacgtcaacgccctcatagagctgctgggcaatacgcatcgtcttggagatcgggaaattcaatgtcttggatgcctcctgctgtaaggtactggtcgtaaacggcagcggcgctttcttcacgcgctcaccctttttcacttccaggacttcaaaccgctctccgcggatctcgtccatgatacggtccgcctcctcgcggcaggtaatcgccagttttccgttctcgtccccgtggaactttgctgtcaacggcttcttttcgccgtccgccttgagctttgcatccagcgtccagtattcttccggaatgaatgcattgatctcgtcctcgcggtcgcagatgatgcgcagtgctaccgactgtactcttccggcgctcagcccacgctttacttttgcccacagaagcgggctgatcttgtaacccacaatacggtccagaatacgtctggtctgctgtgcgttgacaagattcatatcgatatcgcgcggctgctttaaggacgccttgaccgcgttctgcgtaatctcattgaagctgattctccgcacattcttgccgtccagctttaacgcctggcttaagtgccatgatattgcctctccctcacggtcggggtcggttgcgagatacactttgtctgcctttttcacttctttacgaagcttggcaaggatatctccctttccacggatcgtgatatacttcggttcataatcatgctcgacatcgattcccatctggctcttcgggagatcccgcacatgcccgtttgaggcaactacctcataattttttccaagaaactttttaattgtttttaccttagcgggtgactcgacaataacaaggtacttagccattcatacatctcctttatgctgatttctcaaatccgtctgatataacaattcttaaatgcttccgtaacaaacccctttttcagaagaatccccagaatctgcgccagttcgggcacagacaggtctgtctcctccagaagttcttccatacttttcggtcgtaaatctacacaactatacaccaagcgttcttctttttcaagtaataatttttcaaaggtgcatgtctccccgcccgctccgggatccggcgcaagctcctgtataaacgattcgagatcggaaactgcccccgctccctgccggattaagctgttgcatcccgccgacaaggcatctgtaatcctgcccggaatggcatagacatccctcccctgctccagcgcaaaatccgccgtgatcagcgatccgctccgctgctttgcctccaccacaacaaccgcccggacaagccctgatatgatgcggttgcgctgcggaaaatatcccggaatcggctgcgtgccgggcggatactccgagacaaccgagccccgttccagaatctcctcatacagcacccggctgctcttcggatagcagacatccacgccgcaccctaagacggcgcagctgattccgcccacgtcaagcgctccctgatgccccgcagcatcgatgccgcgcgccattccgctcacaacaccgacgccgcgcgccgcaagcattctcccgagctcccttgcaaccgtccgcccgtattcggagcacattctcgcaccgacaatcgcaacggtctctccctgcgggaggcatccctttacatacagtccgtacggcggatttgcgatatggcggagcctctttggataagatgcatcctccagcgacacaaacgagatcccggattcacacatcttagcgtacgcttcctccatgtccgtcttttgcgcagcccggaccgcctgtatttcttttgccaataattgcagattttccatctgcttttcgctaagaaaatagatatcctgtgcattcccgaccttttcatggatactgattttcgcacagttggagagtccgggaatatttgcaaaccaatacgcataattcatctcttcacctctcccagaactttctgtcaaagcttctgtagcagattgcctcctccagatgccggtcgcaaatccggtctccgccgtccatatccgccagcgtgcgtgccacccgcagaagcttatggtaagatctggcggtgagctgcagctttccgtagatctcttccatatactgctcctgcttcttgtcaagagcacaatactcccggatcttcgtggcaggtatctggctgttgtacgaaaatccttccttccggtagcgctcccgttgaatgtcctgtgccaccgccacgcgcttctgaattgccgccgatgtctcctctttttgctgtccggttaattccccgaatgtcagcgccggcgcctccacacaaatgtcaatccggtctaagatcggctggctgatcctctctaagtaccggtggatcgccgtctgcgtacacctgcatttctgcatatcgggataatagccgcacgggcacggattcatcgccgccaccagcataaaatctgccggatagacataacttccgccaagacgcaccagatgaaccgccccctcttccagcggctggcgcagcgcctcaaccgtctccctggcgaattccggaagttcatccagaaacagcacgcccttatgtgccagtgagatctcccccggctgcgggattcttccgccgcccgtaagcccctgcacactcacggtgtgatgcggcgcccggaacgggcgctgcgtaagcagaccgttctccccggcaagcattccttttacactgtagattttggataactccatgcgctccgcctccgcaagcggcggcagaatggacgggatacgcgatgccaccatggtcttgcccgcacccggcggtcccacaaacagcagattgtgcattccggttaccgcaacttcacacgcccgcttcatcagccgctgtccgtggatctccgaaaaatcaggaagcactgcgggctgtgtttcttctatattatattcctctgcggcgtacttctcccacgacgcatcctcaagaagccgcatgacctccccgatattttccacaccgcagacaagcatcccggaaacaagcgccgcctcttttcgattcgcccgcggcacaatgcagcgccggattccgcgttcctttgcctccgccaccatcgggagcacgccgtgaaccggctgcaccacgccgtttaatccgatctcacccacgatcagcacatcatccagtaccgcatgcggaagccttcccatcgcagccagcaccgccactgcgatcggcagatcaaacccggctccggatttgcggatgtccgccggcataaaattcacggtaattctgcgcggcggcagcgcacaccccacattgcggagcgctgtgcgcacccgctccctggcttctttgacctcagacgccagaaaaccgaccatctcaaaaacaggcatcccgtcgctcacatccgcttccacgcagacaggcacactctggataccgcgtatcgttgctgttgctactctgctatacaacctgttctccttttcattatagaaagatctggaatctctgtgcagtgaacactgctgaatatcttagaaaatacatttgttaaaaagacatgtttagtataacatcatttgtagaaaaagggaagcggcaatttatctcccgccccccgcgctttccattccttttcgcagtttttccagcgcccgtttctcgattctcgacacatacgagcgggatattccaagcgccgctgcaatctcacgctgtgtcatcggtttacaggcatagagaccgtaccggttttctatgatatagcgctccctgccggaaagcagcttcggcacaagtgccagcacctctctggtgcgtctgtcggtctcgatcgtctccaccacatccggttcatcgctctccacaatatccagcagatgaatctgattgccctctttgtccgttccgatcggttcatacagagagacctctctggccgtcttctttttggaacggaaatgcatcagcagttcattgtcaatgcatctcgccgcgtaagttgccaggcggcttccgtaatcttctttataagtagagattgccttgatcagaccgatggttccgatggagatcagatcttccatatcttcatcggaattctgatattttttcgccacgtgcgctaccaggcgcatattccgaagcgtcagttctttttttgcctcaaggtcgccgtctttcatttttttcaggcattccatttcctgttctggtgtgagcggagataagaaagttttcacaacgcacctgaaaagctttattgatacattctatgtatgggccatgttttccgtgcttttcccctcttttttccgcaaacaaatacatgccgtctttacatctcccccgccgcttcgctataatagcgttacatgaaacaggaggaatttttatgctgcgcacccttacctaccgcattttatccgccacggacgggcagaccattctgcattatttaaaaagtctcggctattccgggccgatactggtacatttaaagaaaacagaccacggcaccctcttgaacggcgtgtgggcgcatatgaatgaaacgcttcacaccggcgaccttctctgtcttcatctggaggagaatacttccggcacctccatttttccgcagcagattcccctcgcgatctgttacgaggacgaagatcttctggtgattgacaagccggcaggcatgccggtacacccgtctgccgcgcaccagagggatacgcttgcaaacgccgtcacgggatattaccgtgcaaaaggcgaaatccgcccgttccgctgcatcaaccggctggatgccgacacgagcggcctgatcatcgtcgccaaaaatatgctctccgccgccctgctcggcaaagccatgcagcagcgtatgatccgccgggaatacctcgccgtcgtatgcggcacgctcaccggaagcggcaccgtccacgcgccgattgcccgcgtaaaaccgggcgatgtccgccggcaggttgattttctctgcggggatgatgccatcacgcactataaaagtctcttatgccacgccccctattccctgctctcccttcatctggaaacggggcgcacgcaccagatccgtgtccacatgtccgcgctcggctatcctctggcaggcgaccagctctattatccggcattttcagacacaaaaataaaacggcaggcacttcattcccaccgtttgtctttttctcatcccgtcaccggggagatgcttacgtttacttctccgcttccctgtgatatggctgcgctaattgatccagaaccttctgctcataggggatcttccctgccagcagttcttcgcggataaatgtattgacttccggctcgccccggacagcgagccggtacaaaagcagttcaagaagcgcccgcgtatccttgtgcatgacatgaaaatcctttccatgcaggtaatactctaatgcgctccggtcggtatagcgctccttctggtaatttttcgaggccgctacacggtcgatatacatctccaccacgtaccgcagaggcattttcatgccgcagagtcccttgtccccgccctcgtccggcacgccgtagtcaatccagtattccatgtgatgcttgttccgccctttgtggtgcagccacgcggacgagtatcccttatccttgcgctctgcattgttcgggctcattgttccctgataatatttacagcccaccagaaattctgtcggcgtatatttcgacagatcatgtaataatccctgtttgtataaccccaccgcaaaacagcctttcatgaccagatgcttgtgatggttgatcgtgcaaaaatgtttccatgctttcataataatgtaaccttattttcctgttaatataacgacagactgaccgcaaagttcgatccgcggcgcatccacccgctcctcctcttttaggaacggtgcccgctctctggcggtgtccatcagcagataccactttttcttcccgggaagcttcggaagcgccaatctggtaggacccatgtgaaaattgcaaccgacataaaggaatttctccccctctgttccatcgccatcctcttttccgcagtagagcatgcccaaagactgtctctcgccggaaagatctgaaatccacgcattctctccgtgataggacaaatcgggataccccgttccttttgcatcggaaagctgttttggcatatccgcggcgagcacgggatgctccctgcgaaacgctgccatccgcgccacaaactcccggaaccacgcgtagcgctcatctttcttccagttcacccagccggtcggattgtcctgacagtatgcattgttgttgccttcctgggaatctcccgtctcgtccccctcgtataaaagcgggactccctgcgcgagaaaaagcaccgccaccgcattgcacatctgccgttcacggattcttacgatccgctgcttgcggcttcgtccctccacgccgtagttggcgctcaaattccagtcgcttccatcccggttctcctccccgttgtcttcattgtgtttctgctcatagcagaagagatcccgcagggaaaacccgttattgtccgaaatgtaattgacaaatccgtgatactgatgctgtttgcgctgctggcatgcaaatgcatccataccgccgttcttgtgattgagcagcgcccggacgggatacagatattcgtcattgtatacatacagatgcggataacggcacgggtgccagagcacagcgttctcgaaaccggcgcagaaaatcttcgtccgtctaagccacgcatcctgtgcaatctgcgtgacgggcagattctcccccagcagatggaagccatccacatgatactccctgacccagtaacgcagcgcatctaagatcagattctgattgacattctcaggaaaatacatctccatcacacattccatgtgattctcatggagcgcgcggatgagttttttccattcgacggccgcatcctgccctttcgcgtaggacgcctttaccgcaaaataattggcgggcgcatatccccacaggttcacacgctccggcatcgcacatgcttccggcttgatctgatcctctttccgcacctgccagctgatatattccggcaataccgccttctcctttaagatcagttcctcaaactcatacaccggcatgaactccaccgtcgtgacaccaagttctttcagatagggaatcttatcgcgcaccgccgcaaaagttccccgctcctttgcagggattcccgcatccatcgaaaatccgcggatgttgagcttatagaggaacatctcatggcgcgggatctccggatgtacatccgtcccccacgaaaaagtgtcatccgaataaccaccgcagacccggaactcattcttaacgcgccctgcgtctctccagcgctctctgccgatgatgcggtttgcataaggatcggtcacgaccgtcccgctgattttataattataacgcaggctctctgccttaagccccgcgacaaagactgaccggatcgctcctctgcagcagctttccggcaccttcagttcctgccggattccgccatctttcccatacagaagaatactgcagtcctcttccttttctgcctcaaacgtaaacacgactccgccgcctgcggctgatgccccgtattgtctgtaatcgccctcttttatcgtatacgccatgccatcttccacctttgtcttcgctgcctgcacgtctgcatctcttcgcaatgcacctacacatcatttcgctgtgcacctacacatcatttcgctgtgcacgtccggaaaatcagagatttcccggactcacgggctttcgccctatcagccatgaattttaaaaaattttgccttcgcaggcaaatttttaaaactccctgtctggcactgctcaatagccttcgcgtacattatatcattcccgcttgttttttgtatagttttttctttttcggggagaatgcgcttgtccggcatttgcatctcatgttataatattaagaaacgagagttcttattgtcacagtacgatcgaggtgatgtatatgaaacgaatacccacgacagatttaaagcccggaatgttcacagccagaccggttcgcactgccgcggggcagatcatcctggatgagggctgtcttttgagtgcgcagaccatcctgcacatccatgactattccataccggaagtatggatcagggacagcagcgattcctccggcgggcttcacgattatctgcaaaagcagtacgctccggttcgttcccgttccgagcgtatccggcaaagcgaagaatacaagattttcagtcagaagtttgacagctgcactacgatgcttcacactgcgttaaacgactgtattttacgtgccaaaaagctggagacagacaagcttcttgcagggaccctggatttgtttgcgtcgcatactaccacactttccatgttcgacatgctccataacttacggcagatcgacgattcgacttacgcacacagcgtcaacgtcgccattatctcccgcatgctcgggaactggctcggtttttcggaggatgcccagaacacactgactctctgcggtcttttacacgatatcgggaaatcccggattcctgccagcatcatcggcaagccgggcaggctgacttccgaagagtttgaacagatcaagcgccatccccttttagggtacgagctgcttaaaaaccagcctctcgatccgcacataaagaacgctgccctgatgcatcacgagcggtgtgacggaagcggttatccgttcggtctgtacgcatcggacattgacgactacgcttcgatcatagccgtcgcggatgtatatgatgccatgaccgccgaccgctgttatcgtctggggctgtgtccgtttgaagtgatcgcccagtttgaacaggaaggcttgcagcgctacaagccgcgctatattctcacctttctcgaacacattgcgcacacttacctgcacaaccgggttctgttgaacaacggacagaccggagagattatttttatcaataagcgtctgacgagacctacgatccagatcgccccctcacgtttcatcaatcttgaggagcatccggagctctacattcaggcgattatttaataacatccaataaaggagatatcatgatggcagacaaccataacaccaacgaagacgaggatatcctggtcaccctggatctggatgacggcagccaggtagaatgtgagattttaaccatttttaccgtcaacgagcaggactatatcgcccttcttccgctcaccgaagccggcgagccgaacgaggacggcgaggtctatatctaccgctatgcggaggatagcgatggcaatccgtctctggataatattttagacgacgccgaatacgaagccgtatccgaccgctttgatgagtggcttgacgaggcagaatttaacgacatggaggactgagacgctctcctgcctcggcaataaagcgcgagatatctgcatctttctgattcatctgtttgacggaaaagagatgcagatatttttttgcccgcgtcataccgacgtaaaacatccggcgctcctcctcgatgtcctgatccagcaccgccttcttgtagggcatcactccctcgttcacgtcgatcagatagacgttttcgtactcaagccccttggcggaatgcagcgtggaaagcgctacgctctcactctgcttttcctggctctggtacaggcgttccaattccctggtgtaattctcgatgtgcgcaaaccatccgtcataatcttcatagcctcttgcactttcctgtagttcatccagcacatcataaagttcatccgcccggatacgcctgtaatctgcatactcggcacagaactcgtcatatccgatgcctttccggatatagttgatggcggcaaacggattcatccggcgaagctgcatcacatcatgctccagcgtgacgatccgctccgccacccacggctgttccgcctctctgaaataccattcccacacatcgaatgccaccgtgtcctcgtccaatgaatctctgctgatatagcgcttcgggcggttcatgatctgcagaaaatcacggcgttcccggcttccctgcgcgatccggatataggcaaaaatatcctttgcgatccagtgctcgtaaaggttcggtatgcggtctctcgtcctaaacggaatattgtactccatcatctgctccatcagaagacgcggctgtgtgttagtgcggaacagcacagcaaaatcacggtagctctttcccctctccaccgcatcacaaatatcgcggatgatccgcagattctccttccgctgatcctcaaaaacggcatactccaccccggtctccgccgggagtgccgcgcggatgcgcttctggaagcgctccttattgtgcccgatcagattcagcgcatcctcgacaatattggcctgcgaccggtaattcgtgtcgagaagcacggttttcgtccccggaatttcacgctcaaaccgcagcataatctccggctttgctccgcggaagcggtagatcgactggtcgtcatcccccacaacaaacagatttctctgctcacccgcaagcagcctgaccacctcaaactgaatctggttgatgtcctggaactcgtcaatcagaatgtagggatattttttctgccaggcagccagaatatccttccgctccttgaaaagctcccatgtatacaaaagcatatcctcgaagtcaatcagatgatgcgcatagagatattcgtggtactcgctgtaaactctccggaacacctcttccccgcagttcgtggaatagtaatgatcgagtgaaattccgctgtttttcactagaccgatctcccccagaagcgctgcgatgaactccgactcatcctcatattccagcctgtggcgcttaatgatctcacgcatgcagctcacccgctgctcctcgcggatgatgttctccgcctgatagtggtaggcgtgctttaagatcataaaaaagacggcgtggaaagttccaaacgtcactgcggaagattttccgcccatcaggcgcaaaaaacgttccttcatctccgttgccgccgctcttgtaaacgtgatgacaagaatgtttgccggattgattccatattctgttatcaaatgtctggtgcgttccgtaatgacaagggtcttgcccgaaccgggcccggccagtacgagcatgggaccatccttgtgacggatggcctcacgctgagacgggttaaaactcatagattacctctgattatttctgtaacatggaaatgccttttttgattctcgcaatggattcctctttgcctaaaacctccatcagctctgtcgctccgcccggcgtcatctgtttgccggacactgcggtacggatcggccacatcacatagccgttcttcacgcccttttcctcaacatacttaaggagcgtcgcatagagtgcatcattggaaaaatcctcctgcgcttccagcagcggcaggacgtcgcttaaaacctccagcgaggtctctgcattggtcttcatcttcttgtgtgtgtacatcgcaatatcgtactccggcagttcctcgaagaagtcgatgtggtcgcggatctccgggaaaacctcgatacgggtcttcaccatcgctgcaatcttcttcaaatccatatccttgtgaatgacctcacgcagatacggctccgccatctcataaaaacggtcaaaatccatcgccttgatgtactccccgttcatccactttaacttggtgtaatcgaacaccgccggggatttgctgattctgtgatagtcgaactctttgatcagctcatccagggtaaagatctcacggttgtcctccgggctccatcccaaaagtgcgatgtagttgaccactgcctcggacaggaatccctgctctaagagatcctcaaaggaagaatgtccgctgcgcttggaaagctttttatggttctcgtccgtaattaacggcagatgaatgtacaccggtgactcccagccgaacgcatcataaagacgctgatacttcggtgctgaggagaggtattcgtttccgcgaaccacatgtgtaatattcatcgtgtggtcatcaacaacatttgcaaagttgtaagtcgggtatccgtccgacttgattaaaatcatatcgtccagttctgcgttctccacggtgatatctccgtaaagttcgtcgtggaaggttgtcgttccctcattcggaatattctgacggatgacaaacggcttgccggcagcaagatttgcctcaatctcctccttgctaaggtgcaggcagtgcttgtcgtagagcgtgatctccttgccctcgaccacctctgtcttaagggatgccagacgctccttgtcacagaagcagtaatatgcctcccccttctcaatcagctctttagcatatttcatgtaaatgccggtcttcatacgctcgctctgtacataaggaccgtatccgccgtccttgtccggtccctcatcgtgtacaagtcccgtctcctgcagcgtgcggtagataatctcgacagcgccctccacatagcgctcctgatcggtatcctcaatgcgaagcatgaaatctcctccggcatgctttgcaattaaaaactcatataatgcggatcgcagattgccgacatgcattcttcctgtcgggcttggtgcgaatctggttctgactttactcatcttaaacctccattgtataacaccttacggtgctgtttctttcctgaataacaacagcctgtggctgtcctttgtcttgtgacatgaccacaggctattatataacaatttgatacttctggcaagcggacaaatcctgtgcctataattttttgaagacctctgtctcgcgcttcaaatctgccgcgatgtgctggttctcgtccatatggcgcgtgatgtcctccatgtcgcccacgagcacctgcgtgctgtcggcagcgctggaaacgcccttcacaccctcctcgatcgcatgtgcaatcgtgttgatggaatccgcgatctctgccatcgtcttctttaagacctccgtcttctcggtaaagtctcccatgctggtctcaatgtgggttgccttctcccggtacgcacttccggcatcgacaaacgcctcaaactccggaagaatggaatcattcatatactgcaccagtccgttggaatgttccgtgaggtttccaaccgcctccgtcacaacgcggttgatctgctggatacggttggctgcctcctggctggcggctgcaagctggctgatctccgtcgcaacaacggaaaatcctctgcccgcttcccctgctctcgctgcctcgatggaggcatttaacgccagaaggttggtctggcttgcaatatttaaaatatcatcggtcaggctgtttacctgatttacgctcttgctgtcctcgattgcctgatttaatacagttaaaatctcattgaccttggctccggtagactccatgttctcccttgcggaagcctccatggaatccgcatgttccttcatctcgcgggtgtacgcgttgatctctgacgtgcgctccgcgatctggtcaacttcctgctttacagactcggtgttcgtattgatgagggatgcattggctgacatctcctccatcgtggcagaaagttcttctgtgagtgccgacagatccgacacactgccattcgatgtcacgacgctgtcgcgcacctcgccgaccacagattccattctggttgaattgttcacgatcaccttgaaaatatcctgaagcttgtccataaacacgttgatgccgttgccgaccgccgcgacctcctggttggcgtgcacgctcacacgtctcgtcagatcgccctcgcgcttgtcaatgtcctcaataatatctgtgatctccttctgtgtctttaacagagggataattaccagctggaatacgcagatcagagttgcaagcaacgccgccacactgatgatgatggatgccgtgctcgccgcgattgccgtccggtagaccgctgcaagctgttcctttgccacatccgcattttcgctgacattggtgcggattgccgcaatgctctcctgcattgcactggaataatcggcgatcttgccgtttgccagcgcataagccgcctcgttatcgttgttggcactgtatgccatgaggttggcaagctcgtacttcattccctcgtagttggacaccagcgcatcgtattccgccttgttgtcgtctgtcacatattcctggaaatcatccagatatgtctctaaggtctcctgctcactccggatggtctcgaccagcgagatcatggtatttaagtcggtcgccacgatatgggacagtcccagtctgtggatcagaagcgtctctttctgaatatcgccgagctctgaaatacagctcatgtagccgtttgcaatctgcgttgcatttgcatttactctcttaatattggtcactgccagaatattggaaacgactgacacaaatcccaggataaataccggaatcagaataataaactttgtactgatatagctttttttcttcatatcctgctcctccccgttactgtaccgtcgactgtgtaattccagccacaagcgtatccatcacttcctgcggatccgttccgtttgtgctgcctgtcgccatcagattgccgaactccgtcgtcgcatcccagaagctgttgcccacacgctggagtttgccgtactgcgcctgcgcaatgactgcctggatggcaggcaccgcctgtacctgctccgacgcagccgcgtttttattggaaggtccctgatcgcgctcctcaagacgcagcatctggttctcctcgtttgtaaaccagtctgcaagctttaatgcccagtccttgtgcttggaataggcgttgacgcccatcatcttatagcccgtgaaagaggccatctggatctgctgtcccgcgcaggtgtaggtcggaagcttcactgccccgtaatcgttgccccatacctttttgatctccgatgcattccacacgccgctgacgcctgccacaaccgttccgtcctgcacgccctccatgaattccgtgtcggtacagcttaaaaacgccggattctgtgcgatggcaagcagcgcctcctcaatgtcggttccctttatgctgccttccgtcgcattccagtcgcagtagttcgtcaccccgtcgtcatttacaccgaaatccagtccggtgttgccgaaaaacgcatagaggtaccagccggaactccagtccatcgtcaccttcttgcccacagcgcccgctgctgccagaagcccgtccatcgtctggacgtcctcttccgtcaggtaattcttgtcgtaatacagaaaatatccgttgtccgccgtcatcgggtaagcgtacagcgtatcattcacagaagccgctgcaaccgcctcatccagattcgcctcccggatctcatctgcatttggtaccggctctaaggcaccggctgcaaccatgctggtaagctgatcgtccggcagcgggaagacatccgctccgttatgtacatctccaagcagcgtattgcgcgtctcagcatctgcattctccgcaagctgaatatcaaaatctgcctgtcctgcatatttctgctcgaagctgtcgatcatctcctgcagaacatcaaaattggcctcctctgcccatacggtcaatgtaaccttgccgtcatcctccgctacatcgccggacaactctgtcgaatccatgaccgcctccgtctgcaatacggacggttcaccgtttacggactctccacctgccgtcgtatccgcacctgtacagcccgccattgctgttgtaacaaaggctgccgctgcaaccgccgcaataacatgcttcttcatttgaaatccccttcctttgtattcgtatctgtatgtgcaaattctctctgccgcctcttctgttcttatacacgattttgcactcattttatatattttacacctattttacaaaatgcgcaatcggttgttccttttttttaatttttcttatcctttctcccacttttacatccgctgcaggatgagcagtgaccacagcagccacaatcttctttgtctttttttctttttcccatatacaaaagcgccaggatgatccacaaaaggatacaccccagcacaatcagatccaacgcatgcaacccactcaaaagaagattcctcctatctgataaaccgcaaatgccatcagccacgcgaccgcgcattgaagcaccacgacgagaaatgcccgcatgccgcttcccatctcacgcttcaccgccgcaatggctgcaacacacggcgtgtaaagcagcgtaaacacaaggaagcttgccgccgagcgcccggtaaacatacttccgagcaccctgcttagattggcagtcgccgtgccggtcaacacactcaaggtgctgaccaccgcctcttttgccgtaaatccggtaatcaacgccgtagaaaccctccagtccgaaaaaccgagcggtccaaacagcggtgcgatccactgccccaccagagcgagcagacttttctcactgtctgtcaccacattaagcttcagatcaaaggtctgcaagaaccagatgacaatcgttgcaacaaagataatggtaaacgcgcgctccaggaaatcctttgccttatcccagatcagctgtccgacactctttgccgacgggaaacggtaattcggcagttccatgacaaacggaatcggattcccgcggaacgcggtgtggttcagtaccagtgcggacaaaatgcccaccacaattcccgccgtgtagagaagtatcatcacaaccgcctcgttccccgggaaaaatgccgccgcaaacactgcatagatcggtattttggcagaacagctcatataaggcgtgagcataattgtcatctttctatctctctcactcgacaacgtccttgtcgccatgaccgccggaaccgtacagccgaatccgatcagcatcggtacgaagcttcgcccggaaagtccgatcttacgcagcggcttgtccatcacgaaagccacgcgcgccatgtagccggagtcctccagaatcgagaggaagaagaacagcaccacgatgatcggcaggaagcttaacacgctcccgacgccggcaaaaacaccgtcgatgagcaggctgtgtacaaccggattcaatccgtacgcggtaagccccctgtcacagacggcagtaaacgcgtcgattcccaccgccagccagtcgctcaacgccgcgccgaccacatggaacgtcagccagaaaattaaaaacatgatcagtagaaacatcgggatcgcaaggtacttgttcgtgagcacaccgtcgattttcacactccggatgtgctccctgctctcctgacattttttaaccgttttttggcacaccttctctataaaggtataccgcatgtcagctaacgccgcattccgatccaatccacagtctttttccatctccgcaatactatgttccatcatttccagctcattctcagaaagagccagacgttctataatgtccgtgtcattttccacgatcttcgtcgccgcaaagcgcggggacatcccgatatttaccgcatgatcctccacctgatgcgacaccgcatgaatgcagcggtgtaccggcccctgctcgcagaaatccatgactttgggcggtatctttttgcccgcaacttccacaatcgccgcaatcagatcctcaattccctcatccttcgccgcactgatcggaatcacgggaatccctaattcctgcgacatctgcctgtaatcaatggaacctccgtttccgcggacctcatccatcatattgagtgctaacaccatcggaatgtgcatttccagaagctggagcgtcaggtaaagatttctctcgatgttcgtcgcatccacaatgttgatgattccatccggcttctcatttaagataaaatctctggtgacaatctcctcattggtataaggtctgatggaatagattccggggagatctaccacggaacaattcttcgtggagcggatttcccccatcttctgatccaccgtaacgccggggaaattgccgacatgctggttagctcctgtcagctgattaaacaacgtcgtcttaccgcagttctggtttccagccaatgcaaatatcatttttcttcctccggtttcacttcaattttcgctgcgtcctcccgccggatcgtaagctcatacccgcggatgcgtatttcaatcggatctcccatcggagccaccttgcgcacctccacagcagtcttcgggatcagtcccatatctaacagccggcaccgcagtgtgccctctccgccgaccgcagtaatagcagcgcgctttccgattggcagttcctctaatgtcatattttccacacaccttttctcttttgatattgatattcattctcacttatactaatatgatgcttctgcattgtcaaccggcattccggtgtaatggaattttttgtttcagggaacactaaaaggaattgctgcaataagcacagctctctttggggtgataagtaatattataaagaaacgcacttggggatttcatgtggaaatgcagagggaatattcgttggaaaaaaatgtgagcatttcttccagctgaatgtttgcatcagattccgtgtctcttccacgttttgacaatccgccgggtgcatgtccgacacaccagagacaatgggcggactttctggtgtccctaagggcacctcttcacagacaatataaaaccgcgcgaaccgaaactcactgccatctgctattaaaaacatggcagatggcaattcagacatcggcttcgcgcggttatgttttgctcagaggtgcccataagggacacacacaaaagtcctacaaattgtcttccgggatgcggacatgacccgcggagtgctccaaacttggaaagacacggatcatcgaagatgcaaacatccggctggttagaaataccacattttttgaaccgaattttcctctgcattttcatctgaaatcccactgtgtaatcttctgatcatattacttatcaaacccaagtacgatatgcttattgcggcagttccttttattttccgcatcccggatcaaattcgggattacacatataaaagttactgcggtcgagatcgtcctgaatcatccgcaatccctcgccgaagcgctggaagtggacaatctcccgctgacgtaaaaagcggatcgggtcgcagacctccggatccttgaccagacgcagaatattgtcgtaggtcgtgcgcgctttctgctccgccgccatatcttcaaacagatcggtgatcgcatcgcccttagactggaactcgcacgcattgaacggaatgcctcccgccgcctgcggccagatacccgccgtgtgatccacatagtaaggcgcaaaccccgcctcctccagttcctccgcactcagtcctttcgtgagctgacggacgatggaagcaaccatctcaagatgtgccagctcctctgtgccaatatcggtcagcagccccgccaccttccgatccggcatgctgtagcgctgcgacaggtaacgaaacgatgctgccgcttctccgtccgggccgccgtactgcgacaaaatgatctgcgcgatcttcgcattggggcttgtgatgttgaccgggtactgcaggcgtctctcataattccacattagcagccacctccttcccacggcaggggctgttttgcccaatcccagtaagcatctggatttgccgtatcaatcgtcagcggtccgaatttgtccgcatacacctgcatggcatttctgtgcatttctatatgatgattgaagtaacagatcgcttccgcatcgacgggatgcgtatcaagatactccgcgatgtccaccacggcaaagctcaccatattgatccagtgcagaagctgcgcctggttcatctgtgtcatctgattcatcagcaacgcctgcacccccttcccactgccagaaacggcttatcaagttctgggaatatggttccggtttcaagtgccttatccagttcgtaggtcgttttaaagtgctgccagggaacatatgccatcgcaaccacatattccggctgtctatcagaagctgcatccggttcacacgcacatcggctgcgcgtgtttcctgctgcattgtaatttctcatgcggctctcctattatgatatcttccctttactctatgccgcatcccattcacttgtgctaatctccctcgttaattttatctactgcatttaaaatcttctccatctgggggcgcatgcttccgaccttgtctaaaagctgttctgcctcctctttctgctcgttgacctgcgagagattgttctcaatccgtgcgcgcagcttctgtctgcgcccgatcagtccgtgcttgatctccaccatctccttgggatcgacgagcgcaactgcttgtgttacccacacatgcgcatcgtacagttgataattggagagcatgcgcaccagtctgccgttaaaatattccagatcctcattggttctctgatatttctggcgttccttgaccgcctccagataatactgccactggttttccagttctccagcactttttacatggtatttttcacacgcataatcgaccgcattggcaacattgatatatttcagcttgaccttgttaagcagaacaatcgcacggttctggctccgctccgccacctgtatctccgacaggtcattctggattttcatgtaaataccgcacaccaccaccgcagttgcaaagatcagtcccatccacgcatagtagaaatccttttccagaataatctgtaaaattccgaacaccaccgcgagcgtcaccgccagaccgacaataatatacagcacattttttaactttttctgctgatggtccaggtattccttgcgcagattccactcggacttttcccgctccagatacttcatatccctctgcagcgtgtcacggtgcagttcgttggtcttaaaacgtttgattgcctccggcagttcgcgttcctgctgctctaactgtgtaaactgcgcgtccgacaacttcttggaggagttgagaaattccgtgcgcgccttgtttaactgcaccacatttaccgcgatctcagaaatcttatctctttcttccttcggtatcttctccagagtctcaatatcgttcagataggacgtcacaatccggtattcttccttctcatcgtccagctccttggtcaactcaatcatctgctctaggcgctccaccacgtactgttcaatcttaccggtatttttgtaatccttttttgagagaaccgttgtatttaattctcccatcttactctcaaaatcaggttcctttttctttctcttccaaaaaaacatcgtttcacgcttcctctatattctgcaatttttccgataggtatctttccactctgcaagcattcctgcaatttcatcttcctgcccgtcggcaaacagtccgtccacctgctcttcaaactgacggatctcctccgtccgggaaagctcggaaagtctgtgcgccgcctccgccgcctcctctgccgtcatgccgcattccgccgccgtattcttgaatccgtcatcatcgtgcagacaccggtacgcatagagacattcgcggagagattccggattttcattgagtccgtacgccttccggtaacagtccgctgcttcccgaaaccggaataatccagtatacgcttttcccatgttatgccagacattcccgaccaggatcggattctccgcttcctgatccgcaagcaatgccctgtacgccgagacggctgccgcatagcgcccgtttgtcacatagcggtcagcgcggatcttgctgcactcgtattcggatttgtgttccagctccgcgatctgctgcgcaatctgcgcgatctgcattctgtcacaatacccgctctgcgacagcagacaggtcacaaactcggacagggtgccgccttttctcacaatctcccgaagggcatctgcagcatcttttagtttcagttcccgttccagccagttgcagagatcctcattcataaaatcactgcggagcagatagacattgtggcagatataataacttaattcctccagcgagtaaacgccgattgccgcctcctccacataatatggaaatgccgccatattctgattgcacagaatcaattctcccatcgtcttctcccacacctctacggattctcttccgaaaattccatccggtaatcccacactttatccgaactcttaaataattccccgaatccaagatcccggatctggatccagacctttgtatccgaaaccggttttgccgtgatgcgaagcctcgttgccttgtccgggcgttccggcagatccagaagctttagcttctccaccttcgcctcccgggttcccggcggctgcagccagaaatcaatctccggcgttcccgcaaggatcacttcgcacattccctgcgtctcgtaccagttgtcccctgcactgatcagcgtatagaactctgcttttcccatattccggacttttaagctgacattgactttcatctcattgtcacccagatatacataatcccagttttcctgctgttcactgcacaaggcggcgtagcaggcccccttggagtacagattcttcccgacaaacgctctcctgccctgacacagaaacgccacggactgtttcatccagtccccgtcaaatccgtctcccgtcaggtacaccgacgagacaatatgtccgcggaagcagtcctttagaatgccaagaaaattctcgtcccggctgtccgcattcatccggcgcacttcctccgccagcgagatcagctgcggcgtcgtgcgtttttccttatataatctgcagcagcggatatcctccctgcggtaatcgaacagatacacgtcgtgcatcgaaagttccggcacctgatggtaggcaaaatagtaaaaacattctttccggtcaagcagctgcagcttttcccggtcaattccaagcttcggcgccatcgaaaggaacagctccgtcgcctcccgcgacagcttttccatacagatgaccagccgttccggctcccatcttctgtcggggccgcatgccagtcgtatcagttttttcagatagagggtcagcagttcctccgccggataggtctccccatccacaaaaaccttctcaccgccgaccgcccgcgagagaagtctgccgttcgcctcctcgccctgtgcaatggcaagccgcactgcctcctcgccgacaaaccactgcccgattcctttcttcttggtaatcagcgccggaatctgatagatttcgctccctgcaatcgcagaaaaggtctccggttctttcttattcaattcatagctgctgatcacagcgtactggtcatccagatcgattcccagataaaaccggtgttccatatgttcccctctctgtgctacaatagccggtatgcctcttccgtcacttttgtcatgccataatagcgcttcatcttcccggcaagcttctctctgtcatcgagcgtacacgccagcagcatctcattcagccatgcgtagcggtccccgctgccctcttccataatatccccgttgcccaggcagccgctcgccccgatctgcccgtccgcggtctggctctccaggatataatactgaaccttctccccgaagaacaggataaagtcttttacatagattccgtcatacatttccgtcaattcatccgcaagatattcctgctgtgcctccagccggtaatgaacctcgatctgctgccccggcgcggtgtgatattccagaaagaacttatctgtaagctgatatttgcgcagcagcttttcgtcgaacttccggaaaaatgcaaaatacagattatgccggatgcaggtgtcaagaagctcgtccgcgatctttctgtcacgctccgacaggtgattctccgagagatattttagcagtgcaagccggcagacgcggtttagatcgcccccggtcagataacgctccctgatctggcggaacacatgctccggcacgacggcgtcctccgtgagatacatattggcaaaataagagagatacgccatgcagaccagatctctgccgccccctgcgcaataactttcgtagatctcttccatatgcggcgtgtaatcggtcgtatagagcatctgtgtcagaatccgctcttccagatcaaacgtgtcgatctgaaattcgcccgcagctttccacaattccgccatctgcttggtcggcccattaaaatacttgcagaggtaaatcagcatgacatcgctgtattttccctgccggaaggtgctctccgcaaatcccagcagaaaatcatcctcctcatagccgtgatccgcgatcgcatagctgcagagggagacgcgccactccgtcttcagataatcgtagccgtcgatctgcaccatctgataggccttctcatagaggtggttctccgtcagaagcgcggccatctgcctgcgcacactcacgtcggaaagtgcctccgcgagctgccccttcatcagatccagttccccctccgaataggaaaaatccctgccgtcttttttctcgtaagaaatcagcgcaagtgcaagccggacgagataggttctggaaagtctgcctgactgcagcagctgcaatgcataggtcttctcggtatcgctccatgcctccggctccatatgcctgctcatataccagagcagataggcgttctcccccggtgcaagcgagagacactgacccacataccgctccggatacatcagcgcctcatcctggtataccacactcgaacagaaccggttgccgttcgtatcttccagcacaatgctatactgtggcgtatacgccttaaaataggcggttccgttcacaaacgacacgctctgcggcattttcatctcctcatgccagatgatggctcgggcgatctgacggttggtgcagctgattctgtgtgtgaacaaaagcggcgccagactgtgtgccagttcttcatccagtatacccttgggcagcatctcatcgtagatcaccgccagatgatcgttgatgtgccccgcctcgatctgtgccattgcaaactgctccatcgtgcgctgatatttctggtatacctccggctgtttcgttctggctgctatgatattgacaaacaagaccgccttctgcgtataggaaagcgtactgtcatactggaaatacatctgaatcatgcgcggaactccgcccacctcacgcgcatccagcgacatcagatacgcctcatagagtcctgtaagccttatcttctgctcgattccgagctcataccaccggtggtactcggtttcgtaacactgtgtgcggatcagatatgcacagatggcagaaagcatctcctcctccggctccacctgatacgccgcctctaagatctcgtacagtacccgcgacttctcacgcacctccggcagcagatgcctgatctgctgtgcaagttcctttgtgaggactccctggcgcatcgcccaccgcaggactttcaattcatacgttcccagtctggttaaaagatagggatcctgccagatcagataatagctttccagatagagatacgggctgctgcatccgccctcgatccatgcttcaatcgccttatactttcttggactgctgtaatagtaggattcccgcaaaaacaaaagaatccagaacaacagcgaactcttcggattcttcttaaaaaggagttcaatctcatccgtcagcttatcgacataggacggttccctctcaatcagtgtgcacagatacagatagtatccccattccggcgtctccctgtccctgcagccgcgcttataatcctccataatccacgaagcttcctgcttctgccggttcacaatcaacgcctgcgctttcatcagcgcatacatctcacactccggttccattgccatcatatgatccaggagctccacggactgattcgcccatgcgccggtcacaatctttttcagccggtaatcaatatatagctgtgcaagccgcatccgtccgcgctgtaattccagatgctcctccgatacggcttttgcgccgtccgtcgtggcgcacacttcaaacgtaagcgtctgctccggcaggacaatcgaaagtcttccaaaattcttcccggcatgcatggcagcttttttcacataatatggcacttccagtgtgcttccgataaaatcctcatccgtcagctgactcttttccggcaaaagaaacggcgcgtccgactcaatcgaaatggagagatagccccactcatcccggtgcagcttcaggctctccctgcggtcgccggcgacctgctcgaatgaggcatgatccgcaagaagcgtaaccgcaaccggctttttctgtctgcacccgcgcagatattcctccaccttctgccatgacgccgtgccgtccgcctccccgtcatagagaagacgctccctgacctcggagggctttagtatatttttaaaatgaccggaataaaacagatgatatgcctcttgggcactgctttttgccagtcccgtaaaatcgttcagattcttaatgcgtcccgcagaagtatccgcatacaatctggatacagacacaacaaaagaaaggttatattctccctggttgcagattagaaaaaaatcccccttgacaatatccccttcgatcagtccattgctatgaaattggtaccggatccgcacctcttccccctcaaactggggtgtcagacattccattctggaatcagaagtatagactactccccgaaacggcacatggttcgtacttgtgataatgaaatctccggtgtaatctctaccctccgtcacctcaatgtcgactttatctgcagaaaaagaaagaagcggtctggcgtattggaactttccccttgctagctgttgtatccgtttacgcaaattgacacctgcttttctattgcttttttgaacgcaatgactataatagattataaactaatttggaggagtaatcaatgataaaacacaaggaccattttcatggaagtgatctcgagaaaatagaagaaatctacggcattaaaaaggaagaaattgtcagtttttccgccaatgtcaatccgttaggagtatctccgctgttaaaacacacgctgtccgatcagatcgacgccattaccagctatccggacagggagtacacttctctgcgcagatgcatcgctgcatactgcggaaccgagactgagaatgtcattgtcggaaacggctccaccgagctgatctccctttttattcaggtcgagcatccgaaaaaggcccttgtcattggtcctacttactctgagtacgaacgtgaaatcgcgctgggcggcggcaccacactctattatccgctgcgggaagccgatgacttcaagctcaatgtcgaggattttctctcgcacttaaatgagagcattgatcttctcgtcatctgcaatcccaacaacccgacttcctcctcgatcccgcgcagcgacatgcgccacatcttagacgtctgcaagcagtacgacatctatgtcatggtagatgagacttacgtggaattcgccgataatatggcagaactcacggcagttccgctgacaaattattataacaacatcgtgattctccgcggcacctccaagttctttgccgctccgggactgcgtctcggatacgccgtcacaggcaaccgcgatctgatcaagtccatcaatacacgcaagaatccgtggacgatcaattctcttgctgtcatcgccggtgagacaatgttcaccgacagcgcctacatcaaagagaccaaatcgttgatctcctccgagcgcgcccgcctgtgtaagctttttaataagaatccggacttcaaagtatacgatccaagtgccaactttgttctggtgcgcatcctgcgcgaagatctcacctcgcaggatctgtttgaccgcgccatccggcagaaaatgatgatccgcgactgttcgacgtttccgtttctggataataaatacatccggctctgctttatgaagccagaggacaacgaccgtctgatccgttgtctcttccattagaattaaagagaagcgggatctgtaatattggaggaaagcagataactggaagttccggatagaacagacggcggcaattctgaccgcaaaatccggtatttctaaccatgccgcgcttggcatcttcgatgatccatgtctttccaagcttggagcactccacggactgtgtccgcaagccggcagacaattttaggacttttgtgtgtgtcccttatggccacctctgaacaaaacataaccgcgcgaagccgctgtctgagtcggcatctgccctgttttcaatagcagatgccggcgagttcggttcgcgcggttttatattgtctgtgaagaggtgccattagggacaccaaaaagtccgctcattgtctgcggctcgtcggacacactctgtgagtgtccaaacgtggaagagacacggaattggatgtcaagcacggcatggaagaaatacatgaattttgcttcaaagaattgccgccgtctgttctattccggaactttcggttctcgggtaatctcacaatatcatggatcccgcttttctttttatgtaaactgcttcatctcgtcagttctgcctcggatcgttccgatggccccctttacttcctccgcatagttccggttctgctcgcttatctcacgcacctgctcggcgcttgcagtcacttcctctgtcgctgcagacagctgtgagatattctccacaatacggttgttggaatccgacagtcctgtgatctgtcccgcgatctcattgatatctcctataagctgtgacatattttcattcagacgttcaaaagactctgccgcaaccgcaatcttctcattctggctctctgtcgcttccaccgaagactccaccgaagtcataacgtcgcgtgcattttcattcagctcgttgatgatcgtggtaatctcctccgtggacttcttcgtctgctcggcaagctgtctgatctgttcagcaaccacggcaaatccgcgtcctgcctcaccggctctcgcactctcaatggatgcgttgagtgccagcaggttcgtctggttggagatattgaggatcatgcctgcgatctcctcgacctccttggtcttattctgcaggcgtgtcatggactccgtcacttcatgattcgtcgccgcaatctgctcggactggttcttcaattcttccattacctgcagattctcctgaatattctcattggaatccgtcgccacatccaccatctttctggagcgctcgcccgtctcgtcaatagccgactggatactctgtgtcatattattctgctcttcgatattcttcgccgtcgtgttggttgcggaagaaatctcctgcatgctctgcgcaactgtctccgaagtgtgcaccagttcatccacaagactggtactcctctcagactcatcccgcacagtctttgagatgtcaaggattccttccagcatcaccttctgtttctcaccctcggacgctgcagaacccagtgcatgatcgctgaatgtcttggctatgctgcccacccggtacataatgaaaaataacagatacacacataatacccggcacaagctgtccacatcctgcaaaccaatccccttgattacacgaatgacctccaccagtgtaaataacgccgtaaaagcgatacaggtctgtttatatctcttcatatcataatacggaatctgcaatgtcagaatggcaataagtgcaaaatagataaactctgcatctgtctgcattccaatcaacgcaaattctacgccgacaccgatggcaacaaccctctttaatctcacatcagacttattgcgcagataaaacgccagttcaaccaccgcaaataaaataatcagcacaacatttccgaccgccgtaccgaccgcaatgctcttgctcgcaagcttcgccagcagatacaccccaaacagtacccataaaataaccactgcaaaaatataaaatgtattcatatagcggtagcgttcactcttatctttataaatgtaattcctgtctgaacccgatgtctgacccatagtcttactccctcctgtcactctttctctatcgattcaaaatctttttttattatagttcatttctcctattttttctactgtttttcaattattttgactaattttttacacattccttatcctcgcgcaacacaacgcatccgcttcttttccgtaagctgcggcgggttgctccagcgacataattctactccgacgcagtgagatcctgccgaagggctttttcattcataggacgtaatttcctatgaaaaaatccggcggatacttccgccggatctctcatccccactctttttcatatgccgtatacaaaaactccacgcagccgtctacgcggtacagcctgaaattctgtaaaaacaaaagtgccgcctcgtacattttttcatcctgctcgtccgcaaggcttccctcaagcagataactcatgccgttgtggtattcccgtccgtcctgtatcgtgtagtggcgccacagttcttttcgttgcgcacatgcggtctgctcccgcataagcgtctccagaaactgtacgcacggtctttctgcctcgctgtaatgattccggtacagatacacaaaatggtgcggcggttcgattccggaattcttcaagccatactggttgaccggataattgtccttctgctgcacccagccaaacaccccgtgaaatgtcaatccgccaaccgccgcaaactgcgtcctctgctctaattcctccggggaggataccttctctcccagttccgctgcaattcttccggcaaccacaaaaagccgtctgtgcatctgtgcacagcggtaaaaataccaagcgtcatagtacgtcgtgccggaccagttcaagccgcagcgcgccgtcaggcgctttcccgctctctccatggaaaatacactcatccgcgcattggcacgcaggaaaaattcaaggacagtctccgtgatttgcggctccgtcttcctgccggtgccgcctcccgtgtccttacacttctggcagcacaggccaaacagttctcccacaccgtcctcgtccagctttttttcgtgatagtcccgcaggatggcattggcaatctgatagagaatgttggctttccactttcccaccatgcgcacgatccccatgatatcctcataggattcacaccagagttcctccggatcctccgaatgttcaaaggtgtctcttccggggcggatccagctctcgccgtcgactgccggtctggctttttcgctttccgcctcccgctccttcgcctctttgagcagagactccagaaagagaacgctccacttttttctgccggtcttctccggaatccggtctgctgcgctgaccttttttgtcttcacccgctctgcttccattcctaacctttcgcattgtagcggctgccggtctgccgcgtctgattactgtccgacgcatagcggctgtaattgccgctggtcatataagaagttgcagaaagcgctgccgcctgttttctacagttgctcttcacacccgaagccagcacctgcacgcggttcgacagcgtgctcttatccccgaaaatcttctgcaccgcctccggttttactgtctgaaacaccgtcttatcaaacgacagcgtgccgtctttctccagcgtgattccgatctgttttaaggcggtctcccgcgcggaaatctccgttttcagcttctttgcatacgtctcgtccacactgtccgacaagtcaccaatcttgcggatcatcatattgtaatcggatacaaaactttccatttccttcgtaagctgctttccggcgtcctctccctcctggtaaagggatttttctccctcctccagaaaacgcttcatatgcgtctccacacgctccgccgccagtcccgtgatctcataatcgtagctttttttctgattctccacgattttgtcgccggatacggctgtcccgttttgaaactgatttaaaaactgcatccacgcagatgtcctgtagtttttactctttggcgcgctctgcgtcgttcctttggatgatgcgcgtgtctttgtgctgctggaaaacgcacgcatctttgccagccggttgttcctcgcacccagaatggcagactggtctctgttataaattctcatactcattttccccgtttcttttctgtatccctatcgttcgttaagatacgtctcataagccgacgcaaaatcattaaacttctgtttcgccatcagaatggactccccgttcttcagcaggatcgttcccacctcaaaactttttaccgcggcaaaattcaccagatacccgcgatggcagcggaaaaacccgttgcctaaaatttcttccacctccttcattctggcataatatgcaatgattcccgtgtttgtgtgaagcaccaccttacgccccacactctctgcatagagaatggttttctgatccacacagcaataggttccgtctgttttaatcagcagcgggcgcttcctttctgcccctgcttttctctgtttcagttctcccgcattgtcaaacgcttttctgcggaaccatactggaatctttttctggcactcctctatgccactatccgaaaggaaaagaacatccggcattgtgccgcttccctcaatttcatctccgcaaagaatctgtacatcctctcttacatattcgccttccatctcttttaaatacttacgcacggatgcctcattcccgcacgccgcaatgtataacactcatattcctccccgctttcgcatccatgctctgttttctactttatatatcggtcatatttttcattcttttatttttcgtaacgaaatacgctgtttttgtcatcaaaaaacagttgacacgcttactgtattattgtattatcttattagtacagatgatttagtagaaaggagatgacactatggcatggacccttgattctgatcgtcccatctttttacagattgtggaacgaatccagacggacatcgtttccggccgctaccagccgggagataagcttccgtctgtacgtgatctcgcagcggaagcatccgtcaacccgaacaccatgcaaaaggcctttgcagaacttgaacgcaccggtctggtctattccaggcggaccagcggacgttttatcacggaggattgtcatatgatagaacagttaaaaacctctctcgctaccaagaaaatggaagaatttttagcacagatgcggcagctcggctttcagaatgatgaaatcctgtcgctcatgaatcagacgatgaaaggggaaaaacaatgagtaccttgttggaatgtaaagatctgaccaaatgttacggcaaaaaaaccgccatcgaccatatcaacctcgccattgagagcggacatatcatcggtctgctcggaccgaacggaagcggcaaaaccactctgatcaagatgatcaacggtctgcttgcccccacctccggttccatcttcatgcagcagaatccgatcggcgcagagagtaagaagcatatctcctacctgccggatcacacttatctgaatatgaacgagcgggttcgcgatattatccggtatttttccgatttctatgaagattttgatgagaagcgtgcctacgacatgttgggaaaacttcagattgacgcctcggatcgtttgaagaccatgtccaagggaaccaaagaaaaagtgcagctgattctcgtaatgagccgtcatgcggatctgtatattttagatgagccgatcgcaggcgtcgatccggcagcacgcgattttattttaaatatcattctgtcgaattacgaaccggaagcttccattttgatctcgacgcatctgatcgccgacatcgagaatattctggatgaagtcatcttcatcgatcacggtcagatccggctcaccgcatccgtggatgatatccgtatgaacaacggtaagtccgtcgatgcacttttcagggaggtatacagatgttaaaaaaattatttaaatatgaatttaagagcacggcaaagatcatgttgatcctgtacgccattctgatcatcaccacctccgtaggttccgtggtgctgtattccttagatctggatcaggcgggtgaaagcaaactggcatccattctatccgtctccgcgattgtcctttatatccttgtcatttttgctgtccttatcgtgatgtacgtgtacctgtgtgtccacttctaccgcacgatgtattccgctcagggatatctgacacacacgctcccggtaaaaacacttgctccctttcacgtaaaactgataacctccttcgtgtggatgtttctctccatggctctgatgactgcctccatcgtggcgcttatcgccagcgcctcccacggaaccgcatggcaggattttacttccgcctgggaggagttattcggtcaggacgtattttccttccatttcatcttccagatggtattgggcgtaatctgctcctgcttaacctacctgctctgggtgtttgcaagcgcttcgatcggacagcttttctccagcaataaagtggctgcctccctcgttgcaggcatcgtcctctattttatgcagcagattttctccatgatcctcatgtttggaaccggtatgttccagtcgggagataattccgtgaatttctttgccgttaccacaacgatcgacaatacgaccacatcgacggcaagtatcctgccgagttcactgtttgtcaccagcaacatttactcgatcatcgtcattgtcattttgtaccttgtgtgcgcgagaatcatcacaaagcatctgaatctcgaataacgttctatcaggggctgccacttaagaccggcaacgcctctggatgtgataagtaatattatcagaagatcacaccgtgggatttcagatggaaatgtagatgggatattcgttggagaaaaatgtgagtatttcttccagctgaatgtttgcatcgaattccgtgtctcttccacgtttggacactcacggagtgtgtccgacaagtcgcagacaatgagcggactttctggtgtccctaatggcacctcttcatagacaatataaaaccgcgcgaaccgaaactcgccggcatctgctattgaaaatatggcagatgccggctcaaacatcggcttcgcgcggttatgttttattcagaggtgccaataagggacacgcacaaaagtcctaaaattgtctgctgacttgcggacacagtccgtagagtgctccaaacttagaaagacacggatcatcgcggatgcaaacattctgttggttagaaattccacattttttgaaccgaatttccatctgcatttccacatgaaatccccaagtgtgcctcttataatattacttatctaatatttcttatgcatgaaaggaggctgccactcatgtgacagccccttcccgaatctattacgtatttattttgtgttcaagtatgcgtcaattcccttcgcagccgcttttcctgcacccattgccaggatgaccgttgcagctcctgtcacggcatctccgccggcaaatacaccgctcttggaggtagcgccgttttcttcctctgccacgatacactttctgcggttcgtctcaagtccctttgtcgtggaggagatcagcggattcggagaagttccaagcgacatgatgaccgtgtccgcctcaatctcatactcagaccccggaatctccaccggacttcttctgccggaggcatccggctcgccaagttccatcttgatgactcttgcgccttttacacagccgttctcatccactaaaagctccgtcggattctgtaacaggtcaaaaataatgccctcctcctttgcatgatgcacctcttccttacgcgccggaagttcttcctcaccgcgccggtacacgacatgtacttccgcaccaagacgcttagccgttctcgcagcgtccattgccacgttaccgccgccgacaacgatcactttctttcccgccttgatcggagtatcgtactcctctaaaaatgccttcatgaggttgtttctcgtcaaaaattcatttgccgaaaatacgcccattgcctgctcgcccggaatacccataaaacgcggaagacccgcgccggaaccgataaataccgcctcaaatccctcgttctccatcagctcatcgatcgtgacggatttgccgatgacaacgttcgtctcaatcttcacgccgagcgccttgacattctccacttccgctgcaacgaccttctgcttcggcagacggaattccggaataccatagacaagcacgccgcccgcctcatgcagcgcttcaaaaatggtcacgtcatagcccaattttgccagatcaccggcacaggtaagtcctgcagggccggaaccgatgacagccaccttatgaccgttcaacttctctgccttcttcggcttgatgccatgctctctcgcccagtctgctacaaaacgctccagcttgccgatcgcaaccgcctcgcccttgatgccgcggatacactttccttcacactggttctcctgcggacatacacgtccgcatactgccggaagtgcggatgactcactgataatgtggtaagcctcctcaaaattgccctcttttacctgcgcgataaacgccggaatattgatggataccggacagcccttcatgcactgtgcatttttgcagtttaagcagcgcgttgcctccgccattgcctcctcggcattatatcccaaacatacctcctcaaagttcgctgctcgcacctgtgggtcctgctcacgaaccggtactcttgtcattacgtccataggaacctccatactctgtattttctatccggcagacgcactcattctctctgcctccgccttctaacgatcacatctgccttctcagccgcactgtccgcagccgccgtgatgggtatctccctccgtcagctttaacatcgctctgccctcttctgtcttatattgctgctggcgcttcatcgcctggtcgaaatccaccagatgtccgtcgaattccggtccgtccacgcaggcgaacttcacttcgtcgccgacaaccagacggcatgcgccgcacattccggtaccgtccaccatgatcgggttcatggaaaccaccgtcggaattcccagttcctttgtcagcttacagacaaacttcatcataatcatcgggccgattgccacacaatgatcatagcgcacgccctgatcccagagttcctgcagctgcgccgtgccggttccgtgaaagccgtaagagccgtcatccgtcgtcacatagagattcgctgccactgcccgcatctcatcctcaagaatcagaagatccttattgcgggatcccataatcacatcacagtccacaccatgctcatgcagccactttacctgcggatacaccggtgcggtaccgacgccgcccgcgatgaacacaatctttttcttcttcagttcctcgatatcctcatctatcagatcagaaggacatccaagcggtcccacgaaatctgcgaacgcatccccctgctccaaggataccatgcgctgtgtggaagctcccaccgtctgaaatacgatcgtgatcgtaccggcttccctgttataatcacagattgtgagtggaatacgctccccctgctcatcaatcttgacaatgacaaactgtcccggttcgcaatactgtgcaacacgcggtgccttgacatccatcagatagatcttgtctgccagcttttcttttttaacaatcggatacataatttcctcctcgccctttgtactatcttaatataataaaggaaaagcccctacatttcaacggcttttcccatattttctgtttatatctgctattccgacttcgtttcggactgtatgtgacgttttttctccctgcgccctactcctgtgtctccactttggaaaataggatacggtcgttatcgagcgcctttcccgcgcggagcgcaaactgctccaacaagtcatccaccgacatcgccgcacgttcctctcccacaacgtccaacacaatgtttcccgcgttcatcatcaatgtccggttgccgagcgtcagcgcctggtgcatgttgtgcgtcaccatcagacaggtgatctgccgctctgccacaatctgtctggtcagatgcagcaccttctctgccgtcgccggatcgagcgctgccgtgtgctcatccagaagaagaattttcggtgtgaccatcgtcgccatgagaagtgtgagtgcctggcgctgaccgccggagagaagtcccaccggctgtttcatgcggtcttccaatcccatgtcaagcagcgccagctgctctctgaattttttcttatccgccgcgttgatcctgctgaaatatgcattccgggaggttgtcgtccgaagataggcgagcgccatgttttcctcgatcgtcatgtgcggcgccgttccctttaacggatcctgaaacagatgaccgatcactttgcttctcacatgctcctgctgataggtaatatcctccccgccgagcatgatcagaccgcggtccgggaaaaaagctccggtgattgcattgaacagggtagattttcctgcgccgttgctgccgacgatcgttgcgaaatctccggcgccaagcgtcagattgacgccgtttagggcacacttttcattgacggtgccgggattaaaggtcttgctgacatttttcataatcagcatggattctctttctgctgccatatcacgcatttcctccttttcccatccgttcttctctcagtaattccgcaatatactgctcattctccgcttttgccgcccgtttctgccggtagaacaccgcctgcttctttaggtacgggaaagcgatcgccaccgccacaataatggaggacaccagctttaagcactctgccgggacattcaggcgaagcgccaccgccacgataaaacggtatagacagcttcccagaatcacgccgatgacccgctttaacatgctgccctttccgatgatcgtctctccgataatcaggctggcgagcgcgatcgtcaccatgccggttccaaggttaatatcacaggacttctggtactgcgcgagcagtccgccggagagtcccgtcagcgcattggcgacgcacagaccgatcgtaatcatcattcccgtattgatactggatgcccgcaccatatccggattatccccggttgcccggatggaaagtccgagtctcgtatttaaaaacagagagatcaatacgccgaccagtgcgacaatcactgccgccacgatcagcttataccaggttccgccgatcgcgtcttttgcccatgtaaatacggaatcgcaggcaaacagattcaggttggaggcgaatcccatcaccgcaatattgatcgtgtaaagtccggtgttgacaatgattcctgccagaatcgactgtatgccgagtctggtctgcaaaaatgccgtcacaaaaccggaacacacaccggcagccatcgccgccaaaagtccgagtaccggatgtcctgccagcgtaaccgaagcgcacactgcacatcccagcgtaaaacatccgtccgttgacagatccgctatatttaaaatactaaatgaaatgaacagtgcaagtgcaaccagtgcatagataaatcccagttccagtgcactctgcacgatcgataaggtaatgattgatcccatattattcaaactcctctgccgttactgtctcaacaacttccgaacacatatctttaaacatggagtagtccagtccaagtgcttccgccgtctctgtattcacggtcacaattccccgctctaagttctcgatcggagttgccgccggatcggctccgtttaccagaatatcgactgccatatcggctgtctttgtaccaagctcctcataattgactccgtaaccgcagaatgctccgtttaatgcgaaggagtccgctcctgtgtagtgcgggattcccgcatcgatgaacttctcaaagatggaaagttctgccgtcatgacggtgttgtcctgcggggtaaacactgcgtctacgccctctgccaccagggcatccgctgccgcctgcacctccgcagaggtcgtaccggtcttctccacataggcgattcccttctcatcgcagtatgcctttgcgtcctcaatcgcaccaagggaagaagcctgactcttatcatagagcagtccgacctttgcggtatccggatttgccgccagcatcagatcaaaaatcgctgccgtgtcgatggcatccgacgttcctgtaatattggaacccggtgcgttcacatctgccgccagtccggcgcccaccggatccgacaccgcggaaaatacaaccggaatctgattctcctcggtcgcactctgcatcacgactgcggtcggcgtcgcaatcgggataatcagatccacatcatccgccaccagatccgctgcaatctgtgtcaggatcgactgatctgcctgcccgttgaacgtgtaatccgcataatcaaaggtaactccgagctctgctccctttgctgtgagttccgcttcaatcgctttttcaatctgatttaaggaagcatcatccacatactgtacaataccgactttatatacggttccctccgccgctgtctggtctgcctctgccttctgtgtctccgcctgcgcgtctcctcctgcctcattggtcaattccacggtcgtaccggagccggaactgcttccgcagcctgccaccgctgctgccaccatcgtcattgcaagaactgctgtcatcattttctttttcataatcatttcctcctttttcctattacataaaaaaagccgtctcaagctattgcttgagacggtaataaactaatattatcgcggtgccactcatcttgacaaaatgtccactcacttcatgcactatcatacatgccggatggataacgggtccggttcccggcggctcctacctgcgtatccactgctcaggccgccctcaaaagtccattcaacaaatccctccatactgcaatcccaccgcctgcagctctctgtgatctcggataaatgtctactactctttctcaaaggtttatcggtatgtcacttactttaatacattaacgtgtatttgtcaaccttatttttaaatttccatcagacggaacttctcgatcgtctgctccaaatcctgcgcgatattctgaagtgtctttgtgtagtccgtgatgtctgccatcgtcgtgttgacctgatctgtggatgcattgacctcttccgtcgccgctgccgactgctccgatacggatgcaatcgcctccatacgacttacgaccgtatccttgttggatgacatgtccgcattgagccggttgatgttctccatgccggcattcagctgctcaatctgcgcgataatctgacggaatacctcttccgtgcgctcgatcgctttctgctgctccgactgaagctcctcgttctcctgcatggtctcttccacctgcttggacttgtccgtaatctcggtgataatcttcttgatctcatccgttgattccttggactcatccgccagcttccggatctcgtctgcaacgaccgcaaatcccttgcccatctctccggctctcgccgcctcgatagaagcattcaaggaaagcaaattggtctgtgccgtaatatccgcaatcgcatcggaaatatagaaaatcttgtcgatgctggcaatcatctcattcatcactgcaagggacatgctcgacttctctacggtcttctgtgatttttcgatcagatccttcacgctgccgagtccctccgaactgatccggttcgtctcctcggtcatctggttgatctcgctgacacaatctctggaggactccagactgttcttgaggttgtccacctcactgcttgcctcctgcgtgctctccgcctgcttcaccgcaccgtcagccacgctcgagatcgcctccgcgacctgtcccatcgtgcttctggtatctcccgcgatctcggaaatatgatccgaagtctctaaaatatgtctggacttatcctccacctcacggatcactgtggatacatccttgaccatatcgttaaaatgcgtctccagcgcaccgaactcgtctcctctggtgaccgcaatcgtctgggtaaaatctccctctgccacagcagctgtcgcacgctcaatctttttgatctcacgcacaaggctgtacgcggtaataagcgcgatcacaataccgaagatcactccgaacgcacccgcaaataccagcgcaccgttgatcttcgcaagattgccggtgttctcgacatcgctgatgcagcccagaagaatccagcctgtcacctggtctgtcatcgcggtcaccgcacagtccatgccatctgcacgcattgtgtatacagactccagtgtgatgtcggaagcgctctcatcgcccgcttcctccagggcgctcttctgctcctccagagacttcagttctccggaaatcggcgtccagaattccagacccgtcacatttccgtccgcaaaggtatttttgtcactgtcgatcacaatattgccgtccgcatcgatcagcatggcaaatcccgtgttgagaatgcggatattcctgatataattctccagttgcgccgcatcaatatccatcgccacaacgcccattaagacatctttgtatttgacctcctgcgctacggtgaagatctgcccgcctgtctgcggatcctcataaggctgtgtgatatagctgaaaatagaatttacttttgcctttctgccctggcagttcacataccagtcttccccggacagatccacattttcctcgatggtgttcatcgccgtcttatcaccgttgtcctcgtacttcacccatccggtgatgagttttccgctggacgtcgcataatagcttcgcaccgctccctgcgttaccttgcacgccgccaccagttcatcctgcacgttggcaatatagtcatcaaactgatcctcgtactccagctgcttgatggaagtcttgcgcgtcagcagatccaccggaaggctgatcgtcttctcatacgtctgcagactgttcaacgcgctctctaacgtctgctcgcttgtgagctgcatgttgctgtttaacacattcttcgtacggctgtatgtaatcactccacagatcacaacacttcccgcaatcgccacaagaaagctcaaaatcattttcggccctaaacccaattttttcatctttttcctccgttcatactgcaatatgacactttattacttacattgtagatgtttcgcacatttttgtaaatatccggtattttctttcattgtattacattctaaacaaaaacctccctgccggcattctgccagcaaggaggttctcaaaaaaatgcccacgcactctgctcctatgaaaaataaacaagttcgtcttccggcttttctgcaggtgtaatggaaatcggatacagtaccggtccttttcccttgtactctcttgcaaactccaccttgatctgcgcggtaatatgaatccaggacttgtgcggaatcttatcctcatccggatatttgcacttaaatccgatgaaggtaatatcctccacacagcaggtcatcgcaaaacgtcccggaacaaaaatgcccttcttgagcttgtcaggattgtatacaagcgccagaaagctgactttcttcccctcgtatttcttcgggttgtccaggcagtccatataccagattgcataatccgcatctgtaatctccagttcatctcccgagatgtcaaacggcagctcctcctcgcgctcgtcgagcgatccgtccgcgcgctcatacacaagctgtgccttacggttgagcgccttgacatttctgcggtattttcccttatccgtgctgtcgtcacagcggttaaagatcacgacgtccgcctgaaacagctgttccataatcatcgtgcgcatattggcaagatacatatcaaaggtggtcgcatccacggtcgcaagggactgcaccaccatccacccgcgcggaagctccgtctcggtgagcgtatccattccccaggttccgttatattcgatgaacacctgatccggcagatatttcatattgatggcattgagaaaatcagcagtaaaatcttcctcattctccaccatcacgaggcttgcatttatttttttcaactctgcctcatcatattccacctctccgtcttcacagcagatgatcaggctctttccctgatcggcaaacccgttctccagcagcgtctccttgatcagagtcgtcttgccactgtccatgaatccggtaaataaataaatcggtatctcctgcatgttctattcctctctgtcttatctcactattaaaaggcagtcttcacagcttaagcgattccaaataactcctctaatctgtgctcgtcgatatctgttccgatcacgcacagacgtcccgtataatccggctcgccgtcacgcagctcgtactcccccggcaccatgtcaaaataaatccaggagccgttctcatcctccaccatgcccttcgcacggagaatggttccatagtcgtccgtctcgcacagagtctttaagacatcctcaatctttgccttggtaaacttatgcggcgtctcttttccccagcttgtaaacacctcatccgcatgatgatggtgatgctcatgatcgtgatcgtggcagccgcaggtacagttctcgccgtgctcgtgatgatgctcatggtcatgctcgtcgtggtcgtggtgatgctcatgatcgtgatcctcatggtcatgctcgtcatgatcgtgatgatgctcatgatcgtgatcctcgtggtcgtgatcatcatggtcgtgatgatgctcatgatcatgatcgtcgtggtcatggtgatgctcatggtcgtcatggtcgtgatgatgctcgtgctcatgctcctcggcttcttccttcgcatgctgctctgccatcagctttctctcaagagaatcctgtccctctaccacctttaaaatctgctctccacggatggaatcccacggggtcgtgatgatggcagccttatcgttgatggactgaatctgctttacgcagagctccagctgctccggcgtcgcattctggctgcggcttaacacaacagtggttgcatattcgatctggttattgaaaaactcgccgaatgccttcatctgcttgctcgcctttaatgcgtttacaaccgtgatgagcccgttcagctttacatcctcttccttctccacgtcaatcacagacttcatgacatccgagagcttgccgacgcctgacggctcgatcaggatacgatccggatgatacttgccgatcacctcatgcaggtttctgccgaaatcaccaaccagtgagcagcagatacagccggagttcatctcggtgatctgaattcccgcatcctttaaaaatcctccgtcaatgccgacctccccgaactcgttctcgatcagcaccagcttctcgcctgtgaacacttcatcaatcatcttcttgatgaaagtcgtctttccggcgcctaagaatcctgaaataatgtcaatctttgtcatatctatctcttcctttccttacaatacatcatttgttccaaaacacatatattttactcgtttttcctccattttgcaaatcatatgcatttttttcatatattttttataatatttctccggttcactgcttctgaaactgcatgtgatacagtttttcataaattcccttctttgcgaggagttcctcatgcgttccctcttcctcgatgccgttttcggtcagcacaagaatcttctcggcattcttgatcgtggaaaggcggtgtgcaatcacgaatgtggtacggtttttcgccagtttttccagggagtcctgaaccaccttttcactctcattgtcgagtgccgacgtcgcctcgtcaaagatcaggatcggcgggtttttcaaaaagacgcgcgcgattgagaggcgctgcttctgtccgccagaaagcttgatgccccgctgtccgatgtcagtctcatatccctgcggcaatgacatgataaattcatgggcattggcatttttcgccgcctcgatgacttcctccctcgtggcgtccggtcttccgtagcggatattctcatacacggttccgacaaacagatagacgtcctgctgtaccattccgatgtggtcgcgcagactctttaaggtgaggtcccgcacgtccgttccgtcgaccttcaccgccccctccgtcacatcataaaaccgcggaatcagggagcagagtgtgctttttcccgctccggacgctccgacaagcgccatgtaagagcccgccgggaccgtcagattgatatgctgcaatacctgttcagtattctcctcgtactgaaacgacacatcttcaaaagtaatatctccgcgcacatcggtaagctcttttgcatccgcccgatccttgatatccggctcgatctccatgatctcgcagaagcgctcgaaaccgctgtacccgttctgaaactgctccgtgaaatcgatcaatgtccgcacgggatcggtaaatacactgatgtagagcacaaatgtgacaagatcactgacattgaccttaccatttgcaataaggatggttccggcgagaatgacgttgacctgaatcagtgtcgtgaacgcgcccaatcccgcctgaaagcttcccatataatgatagctgttcttcttggcggacaaaaatcccgcatttcctatcttaaactttttcttctcaatctcctcgttggcaaacgactttaccacgcggatgccggagaggttatcctcaatctgcccgttgatctccgcaatcttcacacggttctggcggaacgcacgccgcatttttccgttcaggtaatacgcgtaagcaaacataaacggcaggacgatgaacgccgccagcgccagaagtgggctgatattgaccaggatcacaaacgcaccgatgatcttgatcgccgagagaataatattttccggtccgtggtgcatcagctccgtgatgtcaaacagatccgtcgtgatccggctcatcagctgcccgaccttctggttgtcatagaaagaaaaggataacttctgcagatgctcaaaaatctcggcacgcatgttgtactcgattttcgctcccattacgtgaccgtaattcgagataaagaacttgctatagcagtccgcgaccaccattgcaaacagcgcagccgcaatgattttgatctggtacataatctgcgccttatcctcgtacacgagcgtgtaggtgacatagcgtatcaccagcgggatcgcgagcgcaacggcagccgacaccgtcgcaaaaaacatatccgcccagaaaatgccgcggtatggcttatagtaagacaacatttttttgaaatttttactcattttcacactccttatctctttttcaaaagactcttctattttatctgctacgcgaaaaatgtcaagcgacacgccgcacgaactgtgctatactatacatagttacgattaccatttaaggaggcatcattatgaacccaagacaaatgcattatgaaacgcttgccggtaccatcatcaaaaatcttgccagacgccgcatggaaggctactactgcgccaccgtcgaggacgctgaaaagatggcattctctttccttaccccgggctgcacagtatctttcggcggctccatgaccctggaggataccggaatgctgaccgccctgcgccacgatccgggaatcaccctgctcgaccgcgcccaggcaaagacaccggaggagacaaaaaagatctatcacgatgctctttcttccgatttttattttatgagcaccaacgcgatcaccaaagacggcgaacttgtcaatatcgacggcaccggcaaccgtgtggcagccttaatctacggtccggaacacgtgatcgtcatggcaggcatgaataaagtggctgcaaacgtagacgaggcattaagccgtgttcatggtaccgccacaccgatgaactgcaagcgtctcggtaaaaatacgccttgttccgctaccggcgtctgttccgactgcctgtcccctgactgtatctgcaatcaggtcgtcatcacaagacgaagcggcatcgagggacgcatcaaagtcattctgatcggcgaggaacttggatactaaaatccaggtttccacccgacaaggcagaaaaaatcctgcttgccggatttccacgccgcgcatggctgcttgcgacctgaattctattacgaaaaaaagagttatcgcgaaacggtaactctttttgcatacattagttgtactttctttttcttgctgcttcagatttcttcttgcgttttacgcttggcttctcgtagtgttctctcttacgaatctcctgctgaatacctgcctttgcgcagtttcttttaaaacgacgtaaagcgctgtctaaagtctcgttttcttttacaattacactagacattatctcacacctaacctccctccagttgcgtattgtgcatattcaactgtttgggtcatattcattgcactatataagattataacacatatttttttcccgtcaactgtttttctaaaaaagcgaaaaattcagacaatttactcttcccgcagtttgaatttggtaatcagaccatccagggaatctgcctccgccgaaagttcctcactggtagcagatgtctcctcggaagctgcggaattgctttgaataacatccccaatatccttcacgccgtttgcaattctcttaacggactctgcctgctgatcggaagacacacggatatttgccacttcctgaataatatcgtcaagttccgtcaataccttgttcagggattctgccgtctgctgtgtcacggtgttgccacggtcaacctcactctgatttgcctccagaagatgtctggacgtctcagccgcctgcgcactgttctccgcaagcatacggatctgttctgcaacaaccgcaaatcctcttcctgcctctccggctctcgccgcctcgatggatgcgtttaaggaaagcaggttcgtctgggaagcaatgctctcgatctggccgatcacacttacaagctcctgggaggtgccggaaatacgctccatggcctccgtcagttcctgcatcttctgctggctgacattcgcctccatgccgacttcctttgccttgtcatgcaccacatcggtggatttactgttcgcctctacctgctcagatacggttgcgacactctccacaagatcgtcaaccgcacttgcctgctccgttgctcccttcgcaagatcctgagagctgatagctagctgctctgcgccggctgccacctgatcggaagactcgcggatctgcttaaacgtgccgctcacatcggtcaccatgctgatcagatgtgtcatgacattctcaaattcgccgacataagattccttgcaattggatcttaccgcataattgccctgtgcaaactcttccagaatatatccaagatcctcaataatcttgttcaatgtagtgaccgtcactcggaaactgtccgccagctttcccagctcatcatccgagctgtactgcacttctacatccagatttcctttggagatctcttccgctacttttgtcagctccgtcaccggatccaccactgcatccacgatcttctggctgttcctctggatcagtctcgtatcattgactgccgtaataagaaatacaataagaaccagaatcgtgtaagcgagtgaaaactgcttcggcacataagccgccgcaaaaactgcaatcgctgcaatcacaagcgtcacatacattaccacactgactctccggtaacttccttttaccttatcactcagactaccttgtcccctatctctttcgtccatccctgtcctcctgttttatcagatatgcccatatcccgatacataaaaacggcatattgccgatacctacgtaccattatacaccgtttttactatttgtagcaacaaattataaaatatttttttgaattctaaattttataaatatacgcaatcatgtatttctgtcgagtttttatgcaagctgtgcctcaagtgccgttttcgcctcggcaatggcatccggaatgcctgccggattcttaccgcctgcctgcgccatgttcggacgtccaccaccgcctccgccgactttacccgcaatgctcttgatgagattgccggcatgtgcgccgtgcgccatcgcatcgtctgtcgccatggcaaccagattgacttttccgtctgatgcagatgcaagaactatcacgccttctcccagctttccctttaactggtcgcccagatctctcagaccgttcatatcgacgccgtccacgctgacagcgaggagcttcacacccttcacttccacaacctgatccatgacatctccaagtgcttccttggctgccttgctctttaaggattcgttctcactctgaagtgcctttaactccgccatcagatgaccgatcttctcgacgagagttgctggtgttgcctttgcagccttggctgcagcctcgagttcttcctcttccttcttataatatgcaaatacattgtctccggtcagagcctcgatacggcgcacgcccgcagccacaccgctctcagagataatcttaaatacaacaatatcgccggtgttcgccacatgagtaccaccacagaactcctttgaaaaatctcccatggacacgactcttaccgtctcaccgtacttttcaccgaagagtgccatcgcgcctgtcttcttcgcttcctcgaccgtcatgacgtcggttctgacatcaatcttctcagcgatcttctcgttgacgattgcttccaccttcttaagttcttccggtgtcatcgctgcaaaatggctgaagtcaaatctggtgcgctcaccgtcctgataggaacctgcctgctctacatgtgtgccgagcacttcgcgcagcgctttctgtaacaggtgggttgcagagtggttcctgcaggtatccctgcgcagctttgcatccacactgagatctgctacatctcccgccttaatcataccgtttgtcatcttgccgatatggccgaccttaccaccacgcagcttgatggtctcttccacctgaaagataccggaggcggtgcggatctcgcccttatctccctgctgaccacccatcgtcgcatagaacggcgtcttctccacgatgatcgtgccgacctctccgtcggaaagcgcctccaccagctctgtctcggtggtgagcactgtgatctttgaagatgctgtaaggctgtcgtagcctgtgaactccgtcgtgatcgaaggatcaatctcatcgtataccgtagcatctgcgcccatgtaattcgttgctttgtgtgcatcatgtgcttttttcttctggatctccatggctttcttaaatccgtcctcgtcaatggaaaatcccttctcctccaggatctcctgcgtcagatcgagcgggaagccatacgtatcatagagcttgaatgcgttctctccggacagcgtcttctctccagctgtctgcatttccttctccatcttctctaagatggcaagaccctgatcgatggtcttggcaaacttctcctcttcctgcgtaagcactttgaagataaagtccttcttctcctcgagttccggataaccatccttgctctcatcgattaccgtcgctgcaagcttcgccatgaaagtaccaccgatgccaagcattcttccgtgtctcgctgcacggcgtatgatacggcggagcacatagccgcgaccctcatttgacggcatgataccatcggaaatcatgaatgttgcggaacggatgtgatcggtaatcagacggatggacacatcatcgagcgcatccttctggtaagactttccggacagttcacagaccttgtcgcggattgctttcatcgtatcaatgtcgaatacggaatccacatcctgcatgacaaccgcaagacgctcaagtcccataccggtatcgatattcttctgggaaagttcagtataaccacccttgccatcaccctcaaactgggtaaatacgttgttccatacttccataaagcggtcacagtcacagccgaccttgcagtccggcttaccgcagccgtatttttctccgcggtcataatagatctcggagcacggaccgcatggacctgcgccatgctcccagaaattgtcacactctccggtcttggggtcacggtagaatcttgtgatacgctctgccggcacaccgacttccttcgtccagatgtcgaacgcctcgtcatcctccccgtagatcgacggataaagtctgtcctcctccagtccgagcacctttgtcaaaaactcccaggaccatgcgatcgcttcatgcttaaaataatcaccaaaggaaaagttgccgagcatctcaaaaaaggtcagatgtcttgcagtctttcctacattctcaatatcaccggtacggatacacttctggcaggtcgtcactcttcttctcggcgggatctcctgtcctgtaaaatacggctttaacggtgccatacctgcattgattaagagcagactgttgtcattgtgcggcaccagtgaaaaactgttcattttcagatgtcccttgctctcgaaaaattccaggtacatcctgcgcaattcgttttctccgtaaaacttcttcacgacttcttcctccaacatgtttctttctattttaaatctattttgtctcttcgacgtttccggtctcaccggcattcttagcatccttgcggtcgctcaacttctttcccgcaaaaattccaagtcccgccaccacgaccaaaaccacgaaaatcagtacataatgtacaaaccatcccaaaaatgccatagtcaagtcctgcctttccccaattcttcacaccccgtgtgaaatcttctataactaaatcagtatagcgcaaccgttttatgatcgtcaagtaccgcttttttgaaattcctctcattcctcaaggatctcaaaaatctggttttcatgctttatttccacaacccgctccgccatcgcagcgttcgagatcctcttccgataatccggaagcgcgctgtaatcctgccacatatgcatcggaaatacgtaatccgcatccgtgtgctccaggaaataattcatgccgtcaaactggtgctccatcagcctcggatctgccggcacaaacgccagatgaatcttcctgccggaaagcctgcggatctggctgcggtaatttgtacgcatggatccgttgatcagatcgccggctccgtcccagtgccagtcattcagatcgccggcatggtaaaatgccgcgccgttcgtctccacgtaaaatgccacgcccgcgtccgtcgagcgcagagtctcaatattcaagtcgtcgaccctgcatttttcatccgcccccacatagtgaatccgcttcgctacctccggcgcgaatccatgctttgtcagaaagtgcgggctcatcttacagtcttttgaaaaaataaaccggatcttcggatatttttctgcgagatgcaacacatccatatcaaaatgatcccgatgcttgtggcttgcgaacacgtagacgggcgtatccggctcgtactccggcagcacaccgccaaagtgatacccctccacccggtctccatcaaaccagtcaaaaatcagcaccttctcatccacctcgaccagaaaacaactgtgatgaataaaaataacctgcataattctcctcgtttctccgcaatgtcagaagttctgccctgcaaatctaatgatttctatttcatgcggccgatgatcgcattcgcacgctgatagatctctttcggatcaaacccgatctcgaaatgattgtcttcatagagaactttgccgttaatcatcgtcatcttgacattctgcttgctgccgctgtataccagattcttcacgatattgttttccggctgcatgttcggctggttcaggtcaatcatgacaatatccgcctttttgcccaccgccagacggtcacagtcctccagctgcattgcatgcgcaccgccggctgttgccatgtaaaggatctcatctgcacccacgcactcggcatccatctcgcgcacctttgcaagtgcggaggtaaggaacatctcgcggaacatatccagacagttgttgctcgccgggccgtccgtaccgatcgccatggcaatgccctcatccacaaaccgcttcgtcgggcagatgccggaagcaagcttcaggttagaggccgggttcgtcactgccgtcagatgacgctttttaaagatttcaaaatccggctcctcaaaccatacacaatggtatccgccgccgccgtactcatacatgccgagtgagtccgtaagctgtgtcggtgtcatgccccagcgctctttgcactctgccacctcaagctttgtctcggaattgtgcagccataccggagattttaacttctgtgccagcgccgccacgccttccatcagttctttcgaggtggtgtactccgcatggaatccgacaatgaaagaagtcagatcactcatctcattgacgatatgataattttcctccatcagctctactgtaccgccgaaattgttcagtccgctggtctgcactgtacggaatcccgtatctgcggatgcttttgcatcgaccggcgggaagaaatacatatcaaagttggacgtaatgccgctggtcaggtattccatgatgcccagaatgtttaaccagtatacatcgtcctcggtaagctgtccctcgcgcgggaacacctgctgattcagccagtcctgcagtggcagatcatccgcataggaacgtaaaaatgtcatggctgtgtgtgtgtgcgcgttcttaaatcccggcattaacagattgccgcatgcatcaatctcgcgatcccacaccagcacttctccctccttgcacacatccgccgtgtccgtcccgtcaccgatgtagcagatcgtattccccttgacccagagttctccctccgtgatctcaaacttgtgatgatctgcaagggttaagatctttgcattataaaaacgtgtattcatgtcactttctccttcttctgtctgctgttttcactctatgaagtctctctccagcccgaaatcttcactgcgtctctgcggatattattttccgatgctcttgatcgtctccgtcacaagagccttgaacttcggtgccacacggtctgccgtctcctgtacttcctcatggcagaggggaaccgccgagataccgcatgccagattggaaatgcaggaaatacctacaacgcgcatgcccatatgacgcgctgcgatcgcctcgcatgccgtactcataccaacggcatcggctccgagtgtccggcacatcgccacttccttcggtgtctcaaactgcggaccggaaagctgtaaataagtgccttcctttaaatcaatatccagtcccagcgccgctttttttaccagaagctgtaactccttatcatatacctggctcatatccgggaaacgcacgccaagctcgtccacattcgctccgcgcagcggggaaggaacaaagcttgcaatctgatccttgatcagcataaaatcaccggcgttcatgccaagctggatgccacccgccgcattggtgaggaataaaacctccgcgcccatcagcttcatcagacgcgccggaagcacaacatccgacatgtcatatccttcataataatgaactcttccctgcatgcacaccaccggaacttctccgacatatccgaagataaaacgtcccttatgtcccggaacggtcgataccgggaatccctcgatgtcgtggtaatccagtgtgtctgccacacggatatcatccgcataatcgcccagtccggatcccagcacaagtgccaccttcggggtaaaatcgatctttgccttataactttcatagcatttctgtaacttttcatatactagattcattgtcggttctccttttcctttcgatcacaaaattatttatattatataccatgcgctctgaaattccaatctcattcattaaaaaacggtgccattttctctccgacccacgagatgaccggaccgagtgtgaagcccatcaggatcgtcaccagaccgatcttcgcaccgaacacccacgcaatcacgatcaccgtaaaatcaaataccatgcgcaccacgcggaacggtacctttttctgcgccttcacaatcagaaacggaatagcatcgtagggggcagttcccagttccgtaaccatatacacacctgccgcgacgacgaacaccgccagtgccgggaacagcacgccgatgcgcactgccatggaatcaaacagcccgtccggcaatacttttgaccatacccacgagaaaaaatcaatcgaatagccgacgaggaacatattggcaagcgttccgaatccgatgtactcccgtccccacaatatcacgataataaataaaaggcagttgagcagcgcctgccagttgccgagactcatgccgagtctgcccgaaatagcaagattcatgctcgtgcaggggtctgttccaaaattgaccagcaccagccatgacagagcaaatcccatgacgatcaccgcgagaattaccgagatgagtctccttgcaaaatgtttcttctgatacattccctgaataaagtttttcattattttctctccgttctttccgatatatatcatagtaacacaggaacggcttttctgccagagttcccttttactcctgtgcgcttctctttaaaggcagcattatgattttatggcaattatttcccgctaggaatccgtgacagttttttcggaattcatgacagctttcttggattcacgatatttttcattggacagttatttctcatatcatatttttttcacatgaaaggatttttttatgcagacacttcatctgacagggatcaataaacttcttcatccggagcgcgacaaacgctccgccaccgagcgcatttttgaccatttaagccactcaaacatcggattaaaccgcggcgaagcaacggctgataccggctctgcggcatcggcgctcgacagtttttctgtcacgcagaatatctcggagcttctcagtcccgcctacggcatgagcgaggaagagaaaaaagcctaccttgccaaaatcattgcgaaattaaagagcggcaaaaagcttacatcagaagagatgcgctttctgcaggcggaagatccacagctataccagcaggcggctcgtgtccaggcaatgcgtggctcccttgagtcgggtcttgcgcacagcacttccaaggaggaggcgcaatctgtctatctggacgcgctcacccatatcagcgaggaagatcccatgaaagaatacatcatcgcagcctacgatgatgccatgaaggaattccagaaatccgaccagtaccagtcgctgccagagacaaaagaggatgacgcaaagcagcacaccggttcccgtcattcccatagctgataatttaagttcatgttgcagcaattatctttgtgtgcctgtcttccaagctgccagaacgcaaccgcactggcagctgcaacatttaaagaatcgacgccgtgcgccattggaatgcataccgtatcatcgcatgctgcgatcgtctccggtgccagaccatctccctctgttcccagtacaattgcaagcttgtcctcattcataagcttcggattatcaatacttaaggaatcctctttcaatgccatcgccaccgtatgaaatcccagttcatgaagctgcttctgccaattcccggaatctgctttctcttcctgctccgagtttcgttctatccctgttcccggctctttctcttcttccggatccggatttcgttctatccccgttcccggctctttctcttcttccggatccggatttctcacagtctccggctttgtctcctcaccaagatatgtccacggcacctgaaacaccgtacccatactcacgcggattgctctccggtaaagcgggttgctgcaccccgtggtcaacagcaccgcatccattccaagcgccgcagctgaacggaaaatagcgcccacgttcgtcggatttaccacattttccaaaactgcaattcgttttgcccccttgcagacactccgcaccgaggggagcggctgccggtacatcacacagagcattcctctggtcagttgaaaccccgtcagcttcgtgagtacatcaaactccgccgtgtagaccgggatctccccgcatcgcgcaagaatcttctgtccctctccctcaatatgccttttttccgtcagaattgacaccggcatatagcctgcgtccagcgccctctcgataaccttgggactttccgcaataaacatgcctttttccggctcatggcggttaatcaactgattctctgtcagtcttgcatacacatccaattccggtgcatcaaaatctgttatttctatcatctgtgccattttattcctcttccacatctactgatttctgtttgttcgttgtctcacccgatcttgcggtgccattttcgatcgttttatgctttcggctgttttctgatctgtttctctttgcatcctgacttttgaccgagatttggcttcacagtcgatttcctgggacaatttggttttccttgtaatcaattcattttccctttcgttttccgggcttgatctggctttccgtacggattttggtacctgcatctttttcaaacgggtctgtacggcaaaaatatcctctccagacccgtttttccttgtttcccatcatatttaacatgaaaggccataggaaacgggtctcaggagcactttttcttctctgagacccgaatcacagggaaaaacgggtctcacaggcaacttttcccactatagacccgttggtcatatcaaattcaggatctgagtctcataaacatttaattataataccgatctttatcagaagtgtcaatctatccgtttctacacccggaccggtgtctgtcgtacaaatttcccacctctgtttttcctgcctgcgagttccctgtcacattttcaaatgctcattgcgcttcctcattactgatattttctgatgctttcccgcacattttcctgtcacattttcaaatgctttttctgcttcctttttcttcctgccctacaaaataatgcataccatcccgccgttgttgtcgttcacaattttctgcatagtatcctgcagcttcatttgacactcgtcatccatcatcgagatcttgccgcggatgccgttctccatcagctcaccgatggattttccgaaaatattggtctcccaggctccctcctcgctcttttcgccctctctgatgtaggcgatcagatcattcgcctgctcctcgcttccgacgatcggcgcgatctcggtctcaatattggcacggatcatgtggatcgagggggaggttgcgcggatgcggacgccgaatttatttccgtgcttgatgagcaccggatcttccattttaatatcggagagtccggggcctaccacgccatagcctttcacctgtaccgccgccatcgcgtccgccaccttttcatatgcctcttttcgctgcgacatctccttcaccagcgcgatcagttcatattcgccggcaatcggcacacccgcaagctcgctcatattttcatagtaatacttctcagcgacctccatgcggattttggcgcagccagatgcaagatccacttcctccaatttcatccgcgagacatagtgctccggcgtaaaatcctgtgcataaatatctttcacttttcgcattccaccgaggatcgttctggcgctctgtatgatttccgccttcatcggatgatcgggcgggagcatttccgtccatttcggaatatagaattccatgcgggcgaccgggaactcatataaaatctgctctaatatatgaaagacatcatctttgcgaagctgctcgcaattcaccggcaacaccgccgtctggtacttttcccgaagtccctccgcaatgcggacggtctcctcgctgtagggtctcgtcgaattgagcaccacaacatagggcttgccaatctcctccagttcctgcacggtctgctcttccgcattcacataattttcccgcggcaaatctccgatacttccgtctgttgtcaccacaatgccgatcgtcgcatgatcccttatgactttttccgtaccgatggacgccgcctccacaaacggaatctcatggtcgaaccacggcgtatgaaccatacggtccgtgcttccttccatgtgtcctgtggctccgtccaccataaagccgacacagtcaatcagacggattttaatccgcgtatcatcttcaagcgcgatctctgccgcgtctttcggaataaacttcggttccgtcgtcatgatggtttttccctgtgcagactggggtaattcatcaatcgtgcgctgcctgctatgtacatcttccatatagggaagtaccataagatccataaaccgtttgataaacgttgactttccggtccggaccggtcctacaattccaagatacacctccccgtctgtgcggttttgtatatctttgtataaatcaaactcttttttgctgctgatgtccataaaaataccccttccatacttaataaaatgtatgaagggggatctgtaattattcccgcggaaactaaaatatcatcgcgcgcggatgaccttctggcgcagacaaagccggggatctgtacacttcgcttttctacagcatcacccgcagcattcccggcagacagcggaattgcagcttcgtgacatcaccacagtattctccatccgcatgcagcaccataggatccttcagccggacctcgcatgtgccgcagtcgtctatgtcaaatccgcggattcccgtatgctttgccgccacgaggaacggcaggcataaaaatgtgcgccacttcggaattccgtgtacactgcagatcgaaagctttccgtccgtggcatccgccttcggcgccatgggaacgccgcctccctctgccttaaagttcatcgccgcgatatagatgatgcggtctaacttccgctccggggtctcgtccagacgcaccgcagcctccgtcgtctgcatggaaaaaagcgactgcaccgtaatgagcagataggtcagtttgcccagatgcagcttatttaaaaatactttcagcttcgatgtcagggcttttttgcagactaacgcgtcaagtcccacgccggcactgatggcgaactttctcggcttctcgcagtcatcccatgccacctctcccagatcgatcacggtgcatgcctctctcccccgctgcatgcaggagagcatgcgcgccagattctccaacggcgtgccgctaagctttaaccctctcgccaggtcatttcccgagccggtcggtatcagtccgaaccgcactttttccggatgtgtgatgccgttgatgacctcatttgccgttccgtccccgccaaccactgcaaggcagatatcatcatccgtcttcgcgcagatctcgacagcaagacgtgtggcatgcccctcatgctccgtgacataatgccggtaatggattcctctcttcacaagttctctctgtacctctttccagatctgcgcgcccctgccgcttctggacttctcattcacaataaaataaagcatctgtttctcccaccgtaacatacattctgctgtttccggcatgtgccggacatacaccgctctgttccacgtctgtttttcctatataaacacaatcgaaaacgcccacccggcctctgccagatgagcgtttctcttctgcaatgctcttttttatcgtatcacggatacacggcaattacaactgtttactgctcttttctgtctgcatcttcgcccacccagagacgtccgtacatttccatataattataaagccgtttggcaagcttgacggtaatctgatctgatgttgcacgccactgccagttgccccccagggtggacggcgtgttcatgcgtgcctccgaaccaagaccgatcagatcctgcatcggcaccaccgcaagctccccgaccgaagaccatgcaccacgcatcatgccccagttatagccttcctctttcgtgaggtttaagtattcctttgcaaatttgacgctctccttcggcgcagtcttcatccagccaagcagcgtatcattgtcatgtgttccggtgtacaccacacagtgctccgtgtaggtatgcgggagataattgcttccctctctcgagtcaaacgcaaactgtatgactttcattcccggaaatccggaatccgcaacaagctttaacacggacggtgtcaaaaagcccagatcctccacgataatgtttaatctgccaagcttctgctccagcgtatgaaacagatccatgcccggtcccttgcgccactcaccattctttgccgtcttatcctttgccggaatcgcatagtaggaatcaaatccgcgaaaatggtcaatccggacaatatcgtaaagctttgacattgccgcaatgcgtttcgtccaccaggtgtatccgtttttcttcattacatcccaacggaacaacggattgccccagagctgtccgtcctcggaaaatgcatccggcggacaccctgccacatcaatcggatttaaatcctcatccagatagaactcttccggattcgcccatacgtcagcagaatcccctgcgacgtagatcggaacatccccgatgatctcaatacctttttcattcacataggcttttagctcccaccactgcttgaaaaacagatactgtaacatctgataaaagcggatatccttcgcataggtgcttctcgcctcggcaagtgcctccggttttctcatctttaaatctttttcccaggaaaaccatgcgtttccgccgttggcatcctttaacgccataaacagcgcataatcagaaagccagtctgcctctttttcacagaacgcctcaaaatcgtccggctctgcgcgaaggaaccgctcaaacgcgatctttaacagcttatagcgcgactcgtacatcacgccgtaatccaccttgtctgctttctttccccacgggaaagactcacactccgcctttttcaacagtttttccttacacaggtattccagatctataaaatacggattccctgcaaagctggaaaatgactgatacggcgaatcaccgtaacttgtggggcagatcggaagaatctgccagtatttctgtcctgatttttcaagaaagtctgcaaactttctggcttcttttcccatcgtaccaattccatacggagatggcagggatgatatatgcatcaatactccactacttctcataacctcgtccttacctttcatctatcactcgaatactctccccatttacaaactcaaacggaacaatctcgtgaatcggctctttcttcaactcgatctggccgaataaaatctcgatgctgcggtttgcaagcgtctgatgctgctgcttgatcgtcgccagcttcggattgtaatactctgcaagcgatgtaccgtcaaaaccgatcacggaaacatcctccggcacgcggtaccccagatcacgcagtgcgcggatggccccgatcgccatcacatccgacattgcaaacactgcggtcacatccggaaacttcccgatcaggcgcttcatcgcccggcaggcgcttccaaaagagaatcttgccttctcatagcagtgctccacatcaagaaccgccccatgctccgaaaagctctgctcacatcccaggaaacgctgatgactcgtataagacttgtcaaaatcaccgccgagaatgccgattctgcggtgtccagccacaaacagctgatccaccgcacagcgtgccgctgcaatatcgtccgtggcaacgctggaaagattctcaaaatgcatctcattggcacggttcgtcaccaacacacacggcacatccacaccggagaactcccggtgaaaatattccggattaccgccgaggaacaaaagcccaagcggctttctctccctgcaaagaagaattgcctgctctacctcatctgcatcctcgtccagataagacacgaccagcgtatattccgttttctcgatcatgcgctggatttcctccacgacactggcaaaaagcatatttgagatacctttgaccagtacgccgattgccttggaattgttctgttttaaatgcttcgcattgttgttcggcacaaaattaaactttgcgacaacttcctcgatcttttttcttgcatccgggctgacatcatttctattattaagcactctggaaaccgtgctgacggaatagcctgactctctggcaatatcttttattgtaaccataacttttcctgcctgtttttgtcttcttgatttcactggcaattattatatcagcctttgacagctcctgcaacaacaccttctataatatacttctggcaggctgcataaaaaataatgatcggaacaatggcaagcaccagcatcgccatcatggtaccccagtcaacagcgccgtagccgccctttaaatactggatgacaatcgggatggtcttgtattttttcagatccagcaccagataaggcagcagatagtcgttccagatccacattgcctgcagaattgccaccgtgatcgtggtcggcttcataatcgggaataccacctggaaaaaggtctggagcggcgtacacccgtcaatcattgccgcctcctcaatctcaagcggaatgctcttcacaaaaccgcagaacataaacaccgccagtccggctccgaatccgaggtataccagaataataccgatgggattgcttaaatgcatcatgttcgccagctttgacagggagaacataaccatctggaacggcacgatcatggaaaacaggcataacatgtagatcgtggagttcactttgttatgtactctcgtaatgtaccatgcgcacatggaggtacagagaatgattaccgccacagaacctaccgtgatgataacggagttccccatcgccgcaaaaaagttcgtcttctgcacgcccttgataaagttctcaattccgaagaaagaacggtgatccggcagtgcaaacggatatctcgtgatgaatccttttttctttaaggagttcatcgccacgaggaaaatcgggtacagccacagtaccgcaaggattgagaaaaatacagtcaaaacccatccgtgtttggcgcgtcttaccgcgcttacctgattgtctgcttttttgttctttgccattattgctgcacctccttacttctggtaagtctgttctgtagcattgcaatgactgccacaatgataaagaataccaccgctttcgcctgaccggcgccctcccatccggttctggtgtagaatgtctcataaatattcagtgccagcatctgggaactgttcgacggctcgcccgcagtcagcgccaggttctggtcaaacagcttaaaggagttcgtcagtgtcaggaatgtacagatcgtaatcgacggcattaccatcgggatcgtcacatggcgcagcagctgacggttcgtcgccccgtcaatctttgccgcctcgatcagctcacccgggatgttctggatgccggcgatatagataatcatcatataaccgatctgctgccagttcattaaaattacaagtccccagaatccgtaggttccggaataggtaagtgtctttccgaagttcgccagaataccgtttaacaggatctgccagatatatccaagcacaatacctccgatgaggttcggcataaagaacacggtacgaaacaggttcgttcccctaattccctttgttaaaagcatcgcgatcgcaaatgcaaacacattgatcgtaagaacggacacgaccgtaaacagtgccgtaaacaccagcgcatgtgtgaatgttgcatccgaaaaaatccggatataatttttcagtcccacgaactttgcatcagtcaccgtcgtaaattcacaaaacgataaatagatacccataataaaaggaattataaaaccgattgtaaatgccactaaagtcgggagtgcaaaaacaggaaaatatttcttaattgatttctccatactctttcatcctctcatattcaataaaaccgatatcgggcagatgctttgcagtacccgcatccttctaaaaaagggtgagcagttctcatgcccaccccctgcattttacagatttttattcgtgtgttgcgtcgtactcagtcttccatccatctacgaatgctgtcacaacgccatcccagtcgccggtaccctgtgcatactcaagtaatgcagaaccaacgccatctttccatgtctcagaaggaatagtggagaagttccatgttacagaatacttgccagctttggtgtaagctgcatctgcctggatgaatacattgtctgctgtgtaaccgtcagcaaaagtatcaaacggtgttgtgaatcccattacattagccatggaatcacgtccctcatcagatgtgatcacccactcaaggaaatcaagtgttgcctgctgatcctctgcggatgcctgattattaacgcaccagtagttctcagaacctgtgcagagtccctgattttcctcaccgtccacaccaatgtagatcggcatcatgctcatgtcctcagctgttacgagataaccgttatcctcattggtcaggttgctgtactcccatgtaccgttctggtagaaaacagcttcttccataccgaactcggactcagcctcgtcaccggtcttgctggaaagaagacccggctcacaggtggaatctgtaatgtagagatcccagatctgcttgtagttgtcaaggtatgtaccctcgattgcatcggtggaatcaatgcccttgtccttgtactcatagtagatcggaaggtttgcaaggtgtgtcttaaatctccagtcggaagatccatccatacctgcggaagtaaatgctccctttaagtcatatccgaactggtcgttgatctcgtctaatcttgcctgaatgtcgtctgccactgcctttaatgtctcaaagttgttgatgtcttccggagaagagatcactgcgttgtccattgtgcagtagtcgtttaagatcgtcttgttgtaaatgatgccataagtctcaattacatatgcgataccggaaacctcgccagcgtcattcttcagtgcatagtcatcgctggtcagatgggagtagatctcgctgtttgaaagatccagacagtaatccttccagtttgcaagtcctaccggtccgtttacctggaataaggtaggagcttcggtcttggcgatctctgactttaacgtctgctcgtaagtaccgtctgctgctgtgataaccgttactggaacacctgtctgctctgtgtaggttgctgccagatcctgccatgcctgatcctgctccggcttgaagttcagataataaactgaaccgcccgctgcatccgtcttcgctgcatctgtatctgccgcctctgtggttgttgcagctgcgtcgtttcctgtggtagctgctgcgttactgtctgttgtgctgctgtccccacatccagtaaacatcgttgcgagcattgcacttgcaagcattacggataacacttttcttttcataaatttaccctcctgatatgatttgttcaacttcttatgtaacgtttccggtattgttatcggtaatgtttccggtaacgttttcagttgatggttagattatatttccatgtgtcaggaaatgcaatacccaatcgttattttccacattattgccaagtttcatgaagacattttgtgatatttgtacaaaagaaaggctgccgcgataagcatagacctctttggggtgataagtaatattacaagaaatagatacttaaaagttccagataaacatgcggcgacaaattctgaacgcaaaatccggtatttctaaccatgccgcagctggcatctgtgatgatccatgtctttccaagtttggagcactccacggactgtatccgcaggccaacagacaatttgtaggacttttgtgtgtgtcccttatggcacctttgaacaaaacataaccgcgcgaagccgctgtctgagtcggcatctgccctattttcaatagcagatgccggcgagttcggttcgcgcggttttatattgtctgtgaagaggtgccattagggacaccagaaagtccgcccattgtctgtggcttgtcggacacagtccgtgagtgtccaaacgtggaagagacacggaatgggatgtcagccacggcacggaagaaatacacgaattttgcttcaaagaatttgccgccgtctgtttattctggaacttttttgttctctagtattcctgtaatattacttatcaaagcacgatatgcttattgcgacagcctttcattgcacattttatctggtcgaagatcttatcgtcctcccgtcatgcgaagactctccaccccataaacgatcacgcctgtcagccagacaaaaagtaccatcgtaagcggaagcagcccaaaattccaggacagcatccctataaagcagaccagaaacattccgagcgccgcataattcattgcggtgtaggcacggaacgccgcgcggtatatctgcagctgttcggcctcatcgcagcttgcgatccacgttttctggaacttcagatcgtaaacgcttcccttcttttccggattgatctccttcgtaaaattcacaatccggttctgagcgatcaccgttacgaccataaccgcaatcagtcccaaaaatgtggctgctatttttacccacggaacctcttcctcccagccgctgtctatgccggtggacttcatgccggctgcgaaaaagaaaaatcccgcaatgagcgccacattcgtgacaatcacaccaatgcccagtttccgctcgatcttttcgatcaactgctcttcctcgccgtcccagcgcctgtactctgctctgccgccgcgaagcattcccgtcatccacacagccagagctgccgcgatcacaagatttgcatagggtgcgatcttttgaagtcccgctgtgattcctgcgccgatatccgcctgccccttggctgccatggtcgaaaacgcgcctgttatcccgcccacaaccatggatactaaaagaagcactataaacttgcggaatgctctcctatcctctctctgattctcctcaatcttcgggttgcatttctctgtcccatctgtcatacgcttctcctccctgcctgctatttttcttcctctgattcttcctcataggtaaaaatggcttccaccggaacctcaaacacttttgcaatcttaagcgccaacgtcaccgacggcgaataatccccgcgctcgatctgactgatggtctgcctggatactccgaccagctgtcccatctcgtgctgattgacgttgatttttgcccgatattcttttaaatgattgtataatggcataaatcctccatatcccgatgtgcttttcacacaacgcaccgctttctttgcggcacattttctcacaccgttattatagatatgacaaggaaagttgtcaatacatttttgacaactttccttgtcacatcagtgcatccgacagcgcatgactgacggaacaaccatagcggcatactattgtaaatctgtttgggaaatgctaaaattcagatataagagtatgttatggaaagggaatcacatctaattatgaaagagatcatcaaacataagataacccacaatgtcaaccgcttaaagacttccctgaaatgggtggtattcgccatcctctccggtgtgctggtcggatctgtgggcacacttttttatctgtgcatggctctcgtcactctcgtccgcacaaaaaatccgtggcttattttcctgcttccggtcggaggtattctcattgtaggtgcctaccgcctgcttcacgatgagcgcgataccggcacaaaccttgtactctccgccatccattccggcgatgaactgccgctgcgcatggcgccgctcatttttatctcgacgctgatcacccacctgttcggcggttctgccggccgtgagggtgctgccctgcagctcggcggcagtattggaaacggtctgggacgtctgtttcattttgatgagaaggacaagcacatcatgatcatgtgcggtatgagcgctgcgttttccgcgctgttcggcactccgatggcagccgccatcttctccatggaggtggtgagtgtcggcatcatgtactatgccgccctcgtgccatgtgtgatctcctcgctgatcgcccacgcgattgccacctcgttcggcgtgagcccggacggcttcccgctcggaaaaattccggattttacgatcggctccgccgttgaaatttccatcctcgccatcttatgtgcgctggtgagcattctcttctgcgtgatgctgcacggttcagatcatctgtataagaagttttttaaaaatccctatctgcgcgtcttcgtcggcggatgcattgtcgtcgtgctgacactgctcgtcggggatcagacctacaacggtacgggcatcaacatcatcgcccgctgcatggacggtaccgtccgcccggaggctttcttcttaaagatgctttttaccgccgccacactcggcgcaggttataagggcggcgagatcgttccgtctctctttaccggagcggcattcggctgtctgttcggaaatgttcttggattttcgccgaccctgtgcacagcggttggcatgtccgcagtcttctgcggcgtgacaaactgcccgatcacctcactgctcatcagctttgagctgtttggatatgacggtatgccgtatttccttctcgccatcgcgttcagctatatgctgtctggctactttggtctctaccagagccagaagatcgtctactccaagtacaagaccaactatatcaacaaaaagacgcactaacaggaatagaaaagcgctgccacacgaggcgctgattattatgagtgataccaggaaaaataggagccaaacgttccggatgatatctgtccaagacagatctgaccgtaaaatccggtatttctaaccatgccgcgtccggcatctttgatgatccgtgtctttccaagtctggagcactccacggactgtgtccgcaggccggcagacaattttagggtgttcgtgtgccccttaccgaattgctgaacaaaacataaccgcgcgaagccgatgtttgagttgccatctgccttttttttaatggcagatggcagcgagtttcggttcgcgcggttttatattgtctgtgaagcaattcgattaggggcgctagaacgcccgcccattgtctgcggattgtcggacacactctgtggattgtccagacgtggcaaagacacagaataggatgtcagacgcggcatggaagaaatactcagattttacttcaaagatctgccttggcagatacattcggaactttgtgccctctaatctcctatcctgtcactcatgctaatcagcgcctcgtgtggcagcgcttttctatctcctattctttctcgatacaacggtcgagctgtgcgagcagatcttcgtacttgcagagcccctgcttgcgccagtcgcattttccacagttctccataaagaaatccatgttcatcgccgcgcgtgcgtgtctgcacatctcgcggtatgtatagaccctgttctcctcgagtccgaagaattcgatgacccggcggtctttgttcacgacacggttgtggttgtggacgcactcgttcgtctccgtccggttcggacagttcgcacagatcatatccggttccgccaccagaagaagttcctcgtccggatcttttcgcaggcgctccaccaccgccgtcatattttcacaaaacgcaccgctgtagccttttccctcatagagcgaagtacagacgatgtgatgtcctctgaatttgtctgccatagcaactgtacactcctaaactgccgcttttgtcttctcttccagaatatttcctgctgcaagcgccttgcggatcggaattgccaccagatacgcgcccacaacggagatcacgtccttcacaatgtaaggaacagataccgctacgaaagcagccggaaacggtgtggcagccacgatggcgaactgaatgacaccgagcagatgacacacagcaagaccggcaagtcctaacagcacgcggagccagatctgcttctgtgccatgcccacgccgcagagcattgtcaggaaaatgaatccccagataaatccgccgctgtagccggcaagccaggacggtccgcctgtcattcccgcaaacaccggaacgcctactgtaccgagcaggatatagatcaatgtggatgatgttccctttttccagccgagcacatagccgcacagcgccattgcaaaagtctgaagtgtcaccggaacgccggtcggcatcgggatcgtcaagatggacaacacgctaagcactgccgtaaacatacccactgttacaattgtctttgttgaaatcttcatgattctcctcgtttccgcaggaatcgcatattttaccgctctttcctgctgtttttcgcgcagaaatcccctgtgggtctctctgtctgcaaaaacaatcataacacttttttgtcgattgtcaacctgttttgtctcgcggttgacaattctctaattgcatttccggttctttccaaaaatcaggtcgtaattgatactgtgatagaaaacctcctcgatatcacaggacgatatatcatagttgccaagcatccacatcaccttcgcaatcacggactctaacgtcatatcgtaggactctaagaagcggcaatattctttcatgttgtggccgacctcgtagaccgtcatatcgcttccctcgtgcgccacctgcgtcgccatgaccaccagcttgtccggatgctcctggcacagccggtaaaactcctctgcgatagactgcggtataccgcccacgccaaagctctccacaatgatacagtcataattttcaaaaatactctttaacaccttgggacggattcccgggatcagcttcatcaggaaaacattttcatccagcttctcatagaaccggacttcctcctcgtacggaagcatggggatatagcgcataatattcatgtcctgtatcacggcgagcgacggatagtcaatactggaaaatgcattgtagctcttggaccgcaccttcttggcgcgggttccggcgatgacttttccatcaaacacaatctgtaccccctgtgagcggtcatcggcagcatataaaaagctgtcgatcaggttcgacttcgcgtccgtgatctccaggtcgatcggcttctgcgcaccggtaatcacaatcggctttttcgtgttctgcaccatataggaaagcgccgctgccgtgtacgccatcgtatctgtcccatgggcaatcacgaatccgtcaaaatcgtcgtagtgctcccaaatcgcatgaaccatgagtttccagtgtgacggctccatgttggtgctgtccagatttaaaagctgaaccgcctcgacatcgcagatctcttttacctgcggaatatactcgatcagctcctccggtgtaatctgcggttttaagccgttatccgactttctggacgcaatcgttcctccggttgccagtaataaaatacgtttcttctgctgcatactctctctccgttctatcgtaataatcccctcagtgcagcaagaagcgcctccacgttttcctctttggttgcccagcaggtacagatgcggacagcgctatgcgtatcgtccacacgcgcctgatattcaaatgcaaaatcgtcttttaacttttcaagcaccgcatccggaagaatcacaaactgctggttcgacggcgagtccacataaaattttacgcccatgtcctttagctcatcatggatcttttccgcaagccttgatgcatgcgccgagatctcaaaataccttttctcctcgaatagcgtgaggaactgaatgccgagcagtctgccttttgccagcatgccgccccgctgcttcatattgtaacggaaatcgcgcttcaattcctcgtttgtgatcacaaccgcctcgccaaagagcgctccgaccttggttcctccgatgtagaagacatccgtgagcgccgccacatcggcaagtgtcagatcattttcccggcatgtaagaccgtagcccagtcttgcaccgtctaaaaacagataaagccctctctctttgcagacatcatagatcgcctccagctccgcttttttatagatcgtgccaatctccgtcggattggaaatatagaccatcttcggctgaaccgtgtgttcaaaacttgcgtcggcataatgcgcgtccgtatatgcagcaatctgttctgctgtcagtttgccgtccgccgtctcgatcgtaaggcacttgtgtccgcaggactccagtgctcccgtctcatgtacgttgatgtgtccggtcaccgcagtgatcacaccctgatagtgtcttaatgcagccgaaatcactgtcacattcgtctgtgttcctcccaccagaaaatgcaccgctgcctccggtgcggcgcacgcctcttttatctgctccgcagctgccgcacaatatacatcctccccgtatcccggggtctgttccatgttggttgccgcaagtctctctaagatcgccggatggcatccctctgtgtaatcactgttaaaccgtatcatctttctgattccttttctctatgtatttgagacgcgaaccagctccttcagcttccgtgctgccgcgccgctgtcgatcgcctctgccgctaattttacacccgcttccatagattccgcaacccctccgacataaagagttgcacctgcgttcaaaagaacgatgtcacgcttggcgccgcgctccgttccgtccagaatggctctcgtaatctttgcgttttccccgccgcttccgccacgcagctcctccagcgatacgcgcttcataccgaactgctccggtgtgatggtaaatgttgtcaccgctccatcccggatctcggataccgtggtcgctcctgtaagcgtaatctcatccatgttgtcctcaccgctgaccacatacgcgcgctccaccccaagtctgctcatcgccgtcgctaccttttccgtgagtgacggactgtagacaccgaccaccatattttttgcgcgggacggattagcgagcggtcctaagatattaaagacggtacggattcccatctcactgcgcgcctgcccgacatagcgcatggacttgttaaaaagctgcgcaaacatgaagccgatgccagccttctccacgcattcctccactttcctcggatctgccatgatattgacaccgagcgcctctagcacatccccggcgcccgatttcgacgatatggagcggtttccgtgttttgccaccgggagtcctgcagcagccaccacgaacgccgacgtggtggacacgttaaaggtaaatgtgcgatctccgccggttcccaccagatcaatataattatcaaccttcggggaaatcgtctcagccttgtcgcggagcaccgctgcaaatccagccagttcatccagcgtctcgcccttcacgcgctccagcgccagaaacgccgcgatctgcgcctgcgtcgcatcaccgcttaacatgatgtccatcgccttttttgcttcttcctcagtcagattctctccctcagcaacctttgcaatatattctttcatccctttttcctcctctatgcgttcagttcctttttaaaggtccggcagtatgtctccgccgcctccggcgcaaagccctgctcctccagcagcctgataaaataacttccgacgatcgccccgtcgatcagatccgcaagcggcagaacgtccgccgccgtccggatgccaaagcccatcatcaccggcagatctgtcgcttcccgtactgcggtaagatagcttcttacctccttatggaactctgctccctgccccgtgacacccatggacgatacacagtagacgaacccccgcgctccggcgagaatctttggaatccgcgccccggacaccggcgacacgagctggattaagatcgtatcctccgatgcgttaagcaccgtcatcagttccgcctgctcctcaaacggcagatccggaacgatcagtccgtccacccccgcctcattgcatctttttacaaacgcttccacgccgtagtgcaggatcgtgttgtaatacatcatgaagatgatcgggaccgtcacaccctccgtgcgcagttcctgcatcattgcaaaaatcttcttcacattcaccccgccgcagattgcacggtacgatgcgtcctggatgaccggtccgtccgccaccggatcggaaaacggcacgccaagctcaatcacgtcgcagccgccgcgctcctgcgcccggatgatttcttttgtggctgccagatccggcagtcccgcggtaacataagtaataaatgctttctcctgctttttgctgcaggcgttcatacgcgcttctattcgattcatatctgtcatatcctccctcgccggacaactttccggctcaatttaaatatccttttcctgcaagataatctgcgatcgtattgacatccttgtcgccgcggcccgacagacagatgaccatggtctcctttgccgcctgcttctcaccgaccgcctctttgcgctccctcgcgtacttcatcgcataggcaactgcatgggcgctctcgatcgcaggaatgattccctccagtctgcacagctccatcagcgcatccatcgcctcatcatcccggattgccacatatcgtgcgcgtccgctctcctttaagtacgcgtgctccggaccgacgcccggataatccagccccgctgagatggaatgtgcaagctggacattgccgtccgcatcctgcagcagataggaacgcatgccgtgcagaactcccggctcgccgagcgccatcgccgacgcgtgttccccggtctcgattccctttccggctgcctccacgccgatcagctttacccccttctcctcaataaaatccgcaaacatgccgatggagttcgatccgcctcccacacatgccagcacgacatccggaagcttgccctccgccgcaaggatctgttttttcgcctcgcggctgatgacgctctgaaactccttcaccatcttcgggtacggatacggtcccacagccgaaccgatgatgtaaaaggtatcctccgccgtttttgcccaggtgcggatcgcctcgttggtcgcatcctttagcgtattgcttccggaagtgacactgacaactttcgcgccgagcatctccatgcgcattacgtttagtgactgtcttttgatatcctcggctcccatatagaccgtgcactccatgtcaaagagcgctgcgccggttgccgtcgccacgccgtgctgccccgctccggtctctgcgatcacctttttcttgcccatgcgcttcgccagcagaatctgtccgatcacattgttaatcttgtgtgcgccggtatggtttaaatcctcacgctttaaatacattttcatgccgtacttttcactgagacgctccgcgtaatacagcggtgtctctctcccgacatactgttccagataatagtggtattgtttgagaaattccggatcacggattgcttcctcgaatgccgcatccagttcctctaaagtattcatcagcgactccgccacatactgtccgccaaatgctccgtaatatgctttcctgttcatgtctcgtctttcctttcctgatcatgttccgccgcgccttcttcctgttcagacgccttctgttttttgcacggctttcttaaattttttaatcctgattatactttttgctctcattccgtcacacagcgtttccacgccgctgctgacatctgcgacatcgggggcaaagattctgattccctccgccacattctctgcgttaagtccgcctgccagcacaaaagtacgcccctctgccagcagttcctcccggaacgcacgcacggcacagcacatctcatcctgtccgttctgttcccagccgaatgtctttccgctgccgtacgctccggcatcaatcacaaccccggcaatccggtgatattcttctctgcgccatcggcgaacctcggcaggatcacggaggttgactgccagccacaccggcagcttcgtctgcgctgcgatccgctccgcctctgcggcatccacgccatgcacctgcagcagatcaaatcctgcacgcccgatctcctcaatcaactcgctctccggcgctaccgctacagctacttttcttatatctttatttaatttttcaaataattgtcttgctttctgcactgtgacataacgtttacttttctcgtacagcacgaatccggcgtaatccacacctgtctcattgagcgttgctatctcatcctctcctgtgatgccgcagatcttgatcttcgtcaatgtccatcctccctaccgctgcttccagcgcgctgccacctctcccgggtgctccgcctccataaaggctctcccgatcagaaatgcattcacaccgcatgcttttaagaactccacatcctcatccgatacaatgccgctttccgccaccagaagcttctcctgcggcaccatgcggcttaatcgctccgttgtttgcaggtcaatggaaaaatccttcagattgcggttattgacgccgatgatctttgcatccagctttaacgcccgctccatctccgcctcgtcgtgtacctcgactaacgcatccagccccagctccccggcaagctggtagaattcatgcatctgcacatcgtctaagattgccgcaatgagaagcaccgcgtctgcaccgatcgcccgcgcctcatagaactggtatggatcaatcatgaaatccttgcgcaggatcggaagatcggtcatctgccggatctgttctaagtacgccgtgcttccgtcaaagtgatcctcctccgtcaggcaggagatcgcatccacagaagcattgtattcctcaattctatccagtaagttaatcttgcttttaattttaccgaaacttggggacgcctttttgaactctccgatgatggaaatgacatctccctcaagcgctcccttaaaatcatgatggctgccctcatacgcctccgccagctttcgcatctcctgctccggtatccgtctcttatgttccggcagtcttctttttttatcgctcacaatctgatccagtatcatacgctgctcctcccttaaatgacacccgacaggaaattctcgatcatccgctttccgtgttccgtgtagatggactcggggtggaactggagaccgaccaccggatactctttgtgccgcatcgccataatctcgccgtccgcggtctgcgcggtgactttcaggcactccggcagatcgtctcttagcaccgccagggaatgataccttgccaccttaaccggcgtgtcgatcccggcaaagacgccgtccagacaatgtgtgacctcggactgttttccgtggaataatgtcttcgcatagctcacggttcctccgaacgcctcgccgatgcactgatgtccgaggcagatgccaagaatcggtattttattgtagaaatgttttaccacgtccatacagattcccgcctcttttgggcttttaggtcccggggagagcacaatgcgctccggctgcatattttctatctccccgatcgtaatggcatcgttgcgcaccacccggatgtccggcgtgaaggttccgatatattgatagaggttataggtaaaggaatcatagttgtcaatcaaaagaatcataagttttcctcctccagaagtgttcttgcaagcgccatcactttgttgcagcattcctgatattctttttccggcacggagtccgcgacgattcccgcacccgcctgcagatagacctctctgcccttcttgatcatcgtgcggatcgtgatgcagaaatccatatcgtcggaaaaatcgacataaccggtcgcaccgccgtagagcccgcgccgtacctcctccaattcctcaatgatctccattgcccggatctttggtgcaccgcttaacgttcctgccggcaggaaggatgccagcagatcaaacggatgatagctgccctttttccttccctccaccatggatacgatgtgcatgacatgggaataattccgcacattcataaaatccgtgaccttgactgttccgaattccgagatgcgccccatatcgtttcgcgccagatccaccagcatcacatgctcggcacgctctttctcatctgccagaagttctctgcgcagcgcttcatcctcctccactgtctttcctctcggtctggtccctgcgatcgggcaggtaaacacacgcttgccctgctgttttactaacatctccggcgaacttccgatcacctcaaaattaccgaactggaagtaataaagatacggcgacggatttaactcgcgaagctccttataaagagaaaatccgtcacgtccggtctccaccgtccatcgctgggagagcaccgtctgaaagatatgtccctctctgatatagtgtctgatcttctccaccttcgcgctgtacgtctctggcgtatccgactttttgcggatgacgccgtccctttttccgccctccggctgcgccgcctcctcagtcccgtgcccggtgtccgcttcgcacctgctgtcacatcctccctctgtctgctccggatgcatggcgcgacgtatcatctcttccgccgtcacgccggcacgctttcttccttcctccgtctcctcctctaagacaaccgcggtcagcgtctccgccacatagtccatcacgataaacgctttcatcaacatcagctgaatcgtctcaatcccgatctcatccggattcttctccggcagtttttccgagtagcggataaaatcgtagccgacattgcccaccagtccgccggaaaaattcagttcgtcattctccttatgaatctcaaattcgtcataatattcttttaacagcgctaacggattgcccctgcgcaccccgcgctccccgctcttttttgtgatgacaagcgactccccctccgaggagatcagttcctccggttcccccaaaaacgtataccggtcatagttcttgtcatagctctcgagcagaaatccctttctgcttccgaccagattctcgtacatcgccgtcggcgtctcgttcacaatgctgactgttttcttgtagaccttatagatgcgcttcataaatcctcctctttctttttttaattcatagaaaatgcgtcccatcaagaaagaatcctgctttgcaggattctccgcctgcggcgggtcgctctagcgacataattccgctctgacgcagtgcgatcctgcccggagggctttttaattcattggacgtaatttcccatgaatttaaaaaaatccctgacccggtaaaccggatcagggacgaatgtctcgtggtgccacccttcttctcttgccatgcttagcttctctctttttatcagccgtcctcaccggactcatctgacagaagatacaaaaagcggatacttccaaactggaaatatccgccaccaatcatgtatagactctcagatacagatgttctctatatcgtacccctgtaacgtgaggacacggcttccgctactcggctgctgttatccgcctttcactttgctctcgcaaatccattccatccatactatcctgcctgctcccaccgccccaggctctctgtgaagaatcgtacagtgtactccttttgctcaacgatttctcatttatttgtcagtagtttactgcactaatgtggcaatgtcaagaagctttttattttcccgtcaccttttttctatcaatatgatatactttaagcattgatcctgttacaggaaatggaggaactctcagatgaacaatgatgtatttgaaacaatgcccgtaccgaaagcctatttcaagatggctctgcctgtggtgttcggcatggtcatcagccttgtatacaatatggtcgacacatggtttattgcaaagacccagaacaccagcctcgtcgccggcgtctctctctgcgccccggtgttcagtctcatgattgcattcggtgatattttcgggcttggcggaagttccgccatctcaagacttttcggaaaaaaagattatgacaccgcgcggcggatcagtgctttctgccttctcggctccatcttcttcggcattgctgttgccgttctgatgctgctttttcagacacccattctgcatcttctgggtgccagggacgataccatcgcttatgccggcgcctattaccgctttctggttctcggctgccctgccattatctttaatattgtcccggggaatctgctccgcacagaaggtctggcaaatgatgccatgattggttccgtcatcggcgctgtgtttaatattcttttagatcccattttcatcttctctctgcatatgggtgccggcggcgccgcacttgccaccatcctgagcaatctgcttgccgactgctatctcgtgtgggttgtattcaaaaaggcagggcatctgtcgatgtcctgccgcgaaatgcatatttcatccggtcatgtccgtgacattctgctgatcggaattccggcttccatcacgaacctgatgcagagctttgcggtactcctcaccaaccgttttctgttaccttacggttctgataaagttgccgctcttggcattgccttaaaagtcaacatgatcaccatgctgattctggtcgggttcgccttcggcgcgcagccgctcctcggctactgctacggtgcagacaaccgcgaacgcctgaaacagtttctgcattttgatctgctcgtgcagcttctcattgcgctcgttttcacagccgccgcctgtatttttgctccgcacatcatccgcatcttcatgcaggatgatgtcatcgtggcctccggtgccctgatgctccgttgtctcatgattaccgcccctgtgatcggcatgatcttagtcttcaccacactgttccaggcagccggcatggcgcttcccgcttttctgatgtccatcagccgccagggcgtgctgctcgtgttgtgtatgctgctcttttcttccctgttcggctacatgggaattctgctcgcgcaggcagtctccgatgtcctcaccggaattctgggctttcttctgctgcgcagatcaaaaatactgctctgatgcgccgtgcgtcacaccgtctctgcgctgcggtaaacctgctcaaacgtatctcttgcagtattatgcttcccgatgtcaacaaccaccgcaccgatggacatggaagactttacgtgatccgggagcagggcaatcttctccttgtacagcgcgcaactttctttgcgtacttctgaatctctgcttcctccgtgattccctttaaaaacaggcagaactcatccccgccaagcctgccacagagatgttcattctgacaggtctcgcggattgctgtgccgagtgtccgcagcactttgtcgccgatgtcatgtccgtagtgatcattgacctccttaaaattgtccacatccatcataaacatggtgccggcaccgttctgatacagttcatcaagcatggaaatcttaaactgctctctgtcccagagcccggtcagcgcatccacatgcgcagacatctccgcctgatccagccggttatagtgttccgtcatatcaatcgcccggatgaggtatccctgattctcccccatctcgtttaactgctctgcccgcacgtcaaaaagagcttccttgatcggcacccgctgcccgtgtccgcgcagaatctcatcgaattccatatagtgcacacagcatccagctcttccgtggtaaacaacagatacatggagaacaccgaaaatgccgactcaaaccagtaaatgatttttggcagcgcaatgcggcaaaactccgcaaaaaatcaggtaaacccgatgaccagaaaaagttccccgaaatattctacttttaccgaagcaaacacactcccaagatccgccgatgtcacctcaagcaaaaaaccaagcacataaatcaccgacgccagcgcaaatacttccgacctgcgctctggaaggtctcgcctgtgttattttacatattgcaatcctctgcgcaccggattgcgcaattttacgtctccatatgccgcattgcctgcaccatcgccataaaatcctgctcctttaacagcgcaattccctgttcttcatctcccagaaccatcaatacatcccccggctttatgtcaaaaatttttctcgcctttgcaggaatcacaatctgccctttttcaccgaccttcaccattccaaacgcatgctttcccttcggcaaacacctccgcgatcagccggctcttctccacatccgggagggactctcccgtctcccttaattaaagatattgttgggtaaaaaagaaaggtcagtcgattttgccgatgaagcggtagtagatttctacttcctgctcacggcttccgtcctcgcccttgacagcttcgtggacggttattttttcaattagagtgttcagaagttcggcggtcagctccacagggttgacatactgtttcatcagggcaatccacttttcagcatccgctgcggtctgtacggcggcttccatcgtttcgtgaagctgtcttatttttgtttcaagctccttttgctcgttctggtacttctcggacagcatattgaagttatactcggttatgcgtccggcagaccagtcctcatacattttagcaaacagcccgtcaacctcggctttacgcttctctgcctttttcagctccgcagcctgctttttcttcgcagagtttctttccctgtcgctggcattgagcaggcgtttcagcagattgtcctcgtctttctgtgccagcatagaccagtattgcagtcttgcaagcacataggcatacagtacatcatagcggatatagtgcatggaacactggcgtaatccctgcccgttcttgctgcaatggtagtacccgtatgggttcttattctgcttgttttccccataggctaaagaccatccgcagtctgcacattttatcaatcctgcgaaaatctgtgtcgtaccgtttctgcgtttcctgcgtctgcttgcaatcagctcctgaactttttggaacacttcttcagaaatgatggcttcgtgggtattttccacacgataccattcttcctgcggcttccgcacctttttcttgttcttgaatgaaatgttgctctgcttgttgtgaatgctgtgaccgatgtaggtttcctctttcaaaatgctcttgacctgtgctatcgtccacgcataggctttttctgcgggcgcaccggcgtagatattggcgaaagtcccgtatctttcatagttcagccagccgggggtaggtactttttcctccaccagaatccgtgtaatgctggcggctccacgcccgtgtacagcaaggtcaaaaatcttctctacaatccagcgtgtttccgggtcgatcagaagatgaccttttttgtccgggtcttttacatagcccagcggtgcataggctccatagtgtgcgccattggcaaatcttgtgtgcatggcagccttgacctttttgctggtctgtcgggcgtgcatttcattcaggatgtttaagaacggtgcaagctcgctttctccgttgatggtgtccacattgtcattgatagcaatgtagcgtactcccttgctggggaaatagatttccgtgtactgaccggtcaggatatagtttcttcccagacgggataagtcctttgtgacaacgcagttgattttcccgtcttcgatgtcatcaatcatcctttggaaacttggacgctcgaaatttgtcccactccatccgtcgtcaatgtactcgtctacaacggtcagcccatgctctgcggcatactgtctaagcatcatgcgctgggtctggatactgccgctttccccctgtaattcatcgtcacggctcaatctcaaatatagtgcagtgttataaatcgttgtattgtatggttgtttcacggttaaaaatcctccttctaaaagaaacaacccacgcttatacaatactcgctggtacaagtatatcataagcgtgggctgattgacagtcgttattccgtattttttcaggaagcggcggcagcgtgctggatcacatcttccagcaggctgtcaagcggcttcccatcctgtgcgaaatgctccgataccttgatacggactttccccatgacaaaatactgggtgccgtctttttcggtaagcagggtgccgctgtttttgttattgctctcgtttttgctttttgccataggcagttacctccataaatgaaatatgcccgacaagggaatgtcagacaggtgtacagccgcagactgtctccgtgtcaaccaaaccgtgtcaaccggcagaaaagactttgaaaacaatccataggcgctctattattactttttactttttctttgatttcttggttgacatggttgacaaaggagagaaatgccccaaatatcaggcttttccccgtcaaccggctgtcaaccaaagcgtcaaccaaactgtcaaccggtggcttttcagaatggaagttccatttgccgggcttcttcttccgtgatttcctgaaaaccgtccccctccggcggagcttggttgacacgctcccagcctttttgagaaccgtatttcttataccgcttcggacttttgtaggctacccagccctgtatgatgccgcccgcaatgccggtattcataatctcgcagattgcccgtgtctcccagtctgccggggaatttaagttccccagcgcttcctcataaagctgcttggaacataccctgtcgccggtgtagtcctccaaataggcgtagatcatgccggcctgtgtgtcttcctgcataaagtcctgctggtgggcgttcaggtatcggttcatttccatgctgaatgacagcttatacttcccactgcgataaaccgtcatggcttccgcccacatctgttcgatatacgccctcgccgccgcttcatcgtccagtatgtgaacctccgcccgttccgggtacaccgtcacggggagaaagcgccggttgccggtgcggtcacggggcaaaaagtcctgccggttggtcgtccctccaaatacacattgccgcagccggtctgccggatgtgtctcatacggcactttgtaggtttctttctggcggcttaagaatgacttgatttcctcaatactcttggcgttggctgtggcaatcatctccgacatctcgataatccaatgcccttgcagcttgcggtacacattttcatcgtccagctttttcaaatcgtctgaaaaccattcgtccctgcctgccagcagccggaaaaaggtagatttcccggctccctgaccaccaaccagacagagcatgacctcaaacttgctccccggtctgaatacccgccggatggctcccatcaggaacagtttcaaggcttcataggtgtattcgtccgtatcggctcccagaaagtgatgcagggcgtaacggatgcgctctgtgccgtcccattgcaggctgttcaggtaatccctgactggatggtagcggttttcattggcaacaatcttgatggcgctctgcacctttttctcgctggtaagcccgtaattttcttccagatacaaaagcaggtagttcatgtccatgtcggtcagcgtggtactggtgcgctcccagcccagcggcttcacaatgtcaatctgctccgtcaaaaggttcaggcgcagcgccccgcgaaacagagggtcacgctggaacaccgtcaggcagtttcggatgctgttcttcacgccgcctttctgcgtcccctctaatgtttcccggatttctgccggtgtctgcgccggttccattgtgtccatcgtccttttgaccgcttcctgcgtttccggcggcaagctctgaaattcgctgttcaagccgcaacacctcctttccctgtgcggcgatcaatgccgctttttcttctatttctccgtataacaaaatatccaaaaggtattctgtgtagcttatcctctgcaacgcttccacaaaaagaggatgccagatggcatcctgcggctgtggggcgtgtgctgttttccaatgctccagcaggcgcagataatcgcatagcacccggaaacaataccgttccgtttcctgaaatctctgctccgctgatttttgtcggggctgtgacctgttgtgacgcttcctatctggcggcgcattgccggatttctcataggaaacgccgaagtcctccgcaagcctgaccgcagcttcccgtttccccaatccatgcagcaaagcggcaaagtcgatcacatccccggaagccccgcagccgaagcagtaaaagcggctgtccactttcatgctgggcgtgcggtcattgtggaatggacagcagaccatgccgtttctccccacccggattccatagaatgaagcagcctgccgggtggtaacagactgtttcaccgcttcaaatacattcaaatgctccctccataaaaatactggtagcggtaaagctgccggttatatcatagctccatctcatgtttctttctctgtactgcctgtggctgctccctccggcgcagtgcggtatctacggcgttctgcacctgccgtagccgtatgacttcctcccggagtggcttgtgctgcggagacagttcggcatactctgtttttaactgtgcgtattcctgtttccatgctttcagggcaatgggttttccatccagtttttctttcaaaatacggcgggcggcataaaacagccgtaactccgcatcgtgggatgtttcaaatttctccctctgtttcttaaacttgatattgttcaattccgtatgaacaggttttagccgctggtaattctcgccctcccgtatcaattcctgcaattcctttatccgggcagatttctttttcatggagtcgcttaacgcttcaaattcttcgttgacagaggaaagacgctcctgcaaatcctctaatgtgagcagcttgttttccgtcagataattgacggcttcggcaaactgctttaagtttccggttctggctttattgctccatgcccctgcgttgcgctggttgtaataagcgatcaacaggtcggcaaggctcggtgtctgcggtttggaaagttcttcttttacctctgccatccagacaaacagggctttgatcttcttcctcacatcctgcatgagccggttggtggctttaatccagcggttcagttcccctttctcggtgcggatgccctttgcttccatctgccggacattagctccctcgtggacagtaggtatcaggtcaagcccctgccgcacataggaacggtggtcgatacgcacatccagccctttttcctcaaattttgtattaacggcagccgcccactgctcccgccagtgttccagcgtttccggctcatgccagtctgttgtatggacagcgttaaacatataatcgccgtttttatcccggattcggtttccatcttcatcaagaagatattcccgacgctgtttttgtccccatgtgccatccgggttcaaagggcgcatggttgtcatcacatgaaaatgcgggttagggatgccgccgtcctctttctccgggctgtgaaaagcaaggtcggcaatcatgccttttgtcacaaactgctcctgtacgaacttcctcgccagctccatgttttcttccagcgtcaattcattctgcatggcaatatcaaaggaataggcaagctgtgcttttggatgtttctcgcagttctccacagcattccagagggtcgcccggtcaagatatatttccggcgcatggggcggcagcatgatttccgaagcgatcacgccgccctttttggtgtagtcgctgacttctccatagtagctgctgtaaagacgctccccggctcgataggctgcgctggcaatggcgctctgaccggcgctgcgcttgatctgtgcgattgaaaaatgataaagtgctatccttagtcaccgcctttctcctgcccggaaatacgggcgtggttctctgtggcagaccggatgaaatgctccgcctgcggcagattcaaaatgctttccatgagggaataaaattccgcttcggatagctcctttgtctgtggtgcaatgctctcaatagctgccccacgggtaatcagccggtgcgtcctctgtttccgggaaccgctttccagatacgcctgccggtttttcaaacgctgcattttccgtttttcctgttccagcaggacagtggttttttcatattcctgcttcaactgttccaaagatttttccatgttctcacatcctttgctgataagataaagaaagaccatccgcagacagtccgtgtgtcagtgcttctataaaacccgatgaaaagggaaaaccgcagagcggatttctctttgcggcgggtacacaggggatagccgctttagcggcgcaagggggtgtagccaccttgtcggagcgaagcgaacgcagacctcggattgctgattttatcagcggcagaggtaagctccgcaggacgcacgatacatggtctttagactatgtatagaagtgcgcccttagtttctaagggattttgccgtttccggcagtcttgtcctttttcttggaacgcttggaaagatacttcgggcagtcaaccacaaccgcccggaagctctgtttacattcgtgctggcatttccggcacagttcgttgtaagtgatacggctgcggtcatttaagaagaaagaccattccaaccgccgcttgttactcattcttgccataaccggctcctttctccgtttctatctgatgtacgcagataggctgttttggtgtagcgtttcggtatcatttttaaggtttttccctctgtatacccctttgtaaagtgcggcagtatttgcagtcagggaatgataactcacgcttatttgtcgcttctcggtacggtttcggagccttttgccatccattcaaagaaagcaattttgctgaccttgataagtctgcccctgcggaacgctggaaagccgggtgtgtgtaccagctcataggcgctcgctcttgaaattcccataatccgctgaatgtccgccacatccagaaccagcggtaaatcctcgtagctgttcaatctctttttatcgttcattctgttcctcccataaatcaaataggttaaaatgcttcctgctgccgttctccccaaaagccgttttcctgccccattcctgcggtgtttccctgcattggtgcgccggatgcgtcacttctcctgccggtcatatcccttttggacggtcattcacttgtcaaggtactgtgtggcacgaaattaccaactgcaatcatcatagcggactatccttgacaaaacaatgcttctgcgataccatgagtgtaacagatataaccgaattatataattaccataaacaaaggcaggggatagggatggagaatcagtttatacggcatgagccatgttttgagaggattttgtttgtcctgacgctggacaggaagaaaatgaaagagcggattttgattggggaagaacagcagatccgcttccggctgaacgggagccaaaacgcagaggtgctttgtgatatgacacgcccactgggaacttttttgataaactttgagcgtgacacggacagagattggaacttatatgggctttctccgctgcggcaagccctccactccaacagatggaaacagccggagctggagcaggcggcaagcgaatttctctggggaaaatatcttagcaacgatcctctgaaaatgtatgtagcgttccgtatctggaacagctatctgcttgccagagaaccccgtgaccgtaacgctgcctgtgaccgcttcatggataaaatgagcagcctgaccggggtattccataacgaaaccatgatctttgacagagaaacaggaaaaccgaaacattttcaaactggcagcctttatttcaaaggcgcaccgtcagaagatacccggcttgacctctggttcccggacaaccggcgcacagaagaatgtgtgtctgcctatgcgtccctctacccgttgattacctattatctgaacaggctgaatgactgggggctttgcttccggcagtgcaaggtctgcgggaaatattttctggcaaagagccagcggtatgagctgtgcagcgacaagtgccgaaaagtacaggcgcttcaaaacaagcgggaatttgacgagagggcaagagaaaacaactatgacctgctttataaaaatgaatgccagaactggcgcaacaaaataaaccgagtaaagaataccgcaggctttccggctgaccgtctggaaaaaatacaggctgccttttccgactttaagaaagaagccttgcagagaaaaaaggctgtaaaaacaggaacggccagcccgaaagaatttacggactggctgtatcagcagagtaatgtaattgttgagctgaccgagatatgaaaaactttctatcgtcaatttcgcattattgcaataacagattgcttcttccatgaatggtaatattatcatcaaacttttggaagaactataaatgtccgaggtgcctttgatttcgacaaaaaaacaggctgaattgttacaaagctcggacatttcaaaagaattttttgaaaaacactaaagaagcggagcagctaaaatctgctccgcttcgatatgattgatctaaggatgttttgctatttgattaaactcactctgtcaaccgcaatcgctccacaactggaaggttaacgtcagttttgtagacccatataggcacaataaggcagattagcaacaccagtccagacaccagcaccagtgggataaatggataggagaaaacagcataataggccactttactaaaaatcatatatagcaagatgaagattgctgttccaatggtgactgcaagggaaagggaaacgccccaataatagaaaccttccataaatagcattcgtttgatttgtcgctttgtcattccaatgctttcaagaacagctaattcatagcgccgagtatttacattgacaaccattgtattgacaaagttcatgacaccaacaagcagcaggatcacggacaaccctgttcctaaaacctttgctgtaatgagatattcctgcatttcttctcgccgttcatatcgggatataatatcaatgttagcttgtgatgcggtgatttgctttaattcttgcagtatactttcgtcatgttgaccatccgtatcaaaggccacgcggaacactctatattgcggaaagagttctttcaaagctgtttgactaatatacaaatcaggagccgtccctctctcattgcctcctcctgctcgaaacccttcattcaaataaccgttcgctacaataaaggaatgctgtccgttctgcgtctggattgttatttcctgccccggctgaataaggtcttctactgttttggacagcagcacaacctttccttgttcaaaggcagacgtgtcaataggcaagtttaaggttttattgatttcttccaaatatgcactgtcaattccaaaaaccccactaaaaaagttttgctgataattttctaattttgccggatcagaaaaatcaatgccgtttactccgtctaatgacgcaagaaactcgtgaaatacagcatcgtcatatacaacatctgctactacttgaggataaggtgcataggtcaacctcaaattctcaatgccgtcaagctgaccaacctctgaaaccatttcgctggaaattaaatcttctctttcgtggatactatatgtgagtgcaaaatcgcttactccccattggctcacataattctccgggtttaaaccatgtaatagccctgtgacgacaaggaacaaggaaaggccgaaaaaaagcgatgcaaaaacaagggttgtactcttagcattacgaaagacattgttccatgccattctggacaacttcattttgctacaatttctggcgctactctttgtgctggctgctgtatattggagtgctgctattggtgaaacacttccggcaattttggcgggcttcatgcttgcaatcataacggtaatgaacgtaaatatggccgctcctatgaaaataaacggcgaaaaagatacttttgttcccacatcagaatttgttgaatacatcatattcaggaagtaaggaacaatgccaaaggaaacaaccgcaccaagtaacagaccaatcggaataccaatacaagagattctgattgcctgcttatagataattctctttatctgcctttgggtcgttccaatcgttttaagacggccatagaattgcacatcttttatgacagagacataaagaatattataaatcagcagatagccgctaaaggatataaaaactgctaaaattattacagctaaaataatagttccaccatttgcctgttctaatggtacaatttcaaatgtttgcccttctgtaaagtcaatctcacgccgcaatctttcacagtttttgtcagcattatcattgccttgaaaacggatcattgccgtaacactattatccagtgatacatttaagctatccttaaaagcggatgaaacataaacataaccacgattatttgtgcgcactggaatgtagtccgtatagtagcccgacagcaaaaaggtgtccgtgacataatcatagctatcgccaatttggtatgacaacacaatctccatccctatttgcggatcagaaatgcccatctgttcaagcacccatgtaggtagcataatttcgtttttacttgatgggtaatttcctacaacacctgatatagtaggaagacggtggtgttcccactctgtatcatttatccatactacacctaatcttgcgtttctcagttgttctgtatcaacactacctaaacgctgctgtatacctacgtcaaggacaaggtttgattttgaaatttcaaccaactgattttctgttacatttgtgattccgacatcagcggtagttcccattaaccgaatttgttgcatttggtaggtttcaaagtaactaaaaccaatactgaatgtcgcagttatcataaatgcagttagcacaagagcaatgattgcaaataaattacgctgccgttcacgatgcaaactgcgctttgccagcttcttttcaatgtcactggtatcattttcaaaaggccatgtcatagcttgccacctccttattccacaatcctgccatcctcaatgcggacaatccgatctgcaaggcgggctatgtcgtcattgtgggtaatcattacaacggtttgccggaactccgcgctggtgcgcttgataagtcccagcacctcggcgctggtcttgctgtcaaggttaccggttggctcatcggccagcacaatagccggtttggtaatcagagcgcgggcaatcgccacacgctgctgctgtccgccagaaagattattcggcatatttttcagtttatcttccagccccagcaggtgaacgatctcgtccaaaaacttctgatccaccgtgtccccgtccagctccaccggcaggacgatgttctcatacacattcagaataggaacaaggttatagttctggaagataaagccgatgttgcggcggcgaaagatggtaagctgttcatcgttcttctttgccagttcttcgccccggacgatcacggttccgctggtgggagtgtccagcccgcccatcatgtgaagcagggtggacttgccgctgccggatgttcccacaacggccacaaactcgccgtcctccacggagaagttcacaccgtcaagggcgcgggtaatgttcggctctgtgccgtaatactttttcagatcaatcgcctgtaaaacgctcatactcaaaactcctttcaaggctttctgcctgttgataaggctattgtaaaacccaaatgtccgcgaaatgttacagcggccaaaaaatttcattgaaaatcgggggtgaaatgttacaacgctcggacatttccgccgaaaaactgccactggcagctttatcggcacactgttgcgaaaagacttacggcgggcagccggaaatggccgtccgccgcgttctattttgtcggcagcataatggaaaattctgaacccttgcccggctccgaaaccactttgatatagccgccttgccgcgttacgatctcgcgggccagatacaggccaatgcccacgccctgctgttcgtgtacttcttcctcacgatagaagcgccggaagatggcagcctgattgctttcggaaatgcccttgccggtgtcgactactttgatctccacatacatttcccacagcaccactgacacggcgattttcccgcctgccggggtgtacttcactgcattgtccagcaggttaaagagggcttcggatgtccacttgctgtcatggaaaacggtcaaatcctccgggcagtccacggacacagcgatttcctttttctccgctgcatacacaatcccactcatggcctgcgccacggtatcaaagaggcgacccggcttcttgtctaactggatcacgcctgtttccagccgggaggtttttacaagggcctgaaagagaaagtccagcttatccgtctggctgcggattccccggataaagtcggtgcgctccgcctcggtcatgggcttttccagcagggtgtccgtcgccattttcagattgctcaccggcgttttcacctgatgggaaatatctgatacaagggtctgtaactcctgccgttcctcgtccacccggcggcggttctcctgcatgatctggtaaagccttgccagccggtgtccgattctagcaagctgggtttcgctgtcctctgggcgctggggcgcttcattcccagcgatcatgtggtctaaagtctggcacaggtcagcggtaaactgcgacagccgctttccaaacgcctgcgtcagtacaaaaatccccacaagggcgcacagcagcagcgccccgcccgtcagcagcaccgcaatctgttttgtcacaaaaaacagggctatggtgatcccggacatggagaggacaagccccattgccacccggccaaacagccgctttaccgagaggttttgaaacttcattttgcctcgcctcccgtccattgatagcccatgccgtaaacggtcttgatgtagggggggccgccatcagattcaatcttgctgcgaatccggctgatggaggttgtcagggtgtgttcgtccacaaacctttcatctatatcccacagcttttccaaaagctgcccacgggtcagcacttgccggggatttttgcggaacaggttcagcattttgtactccatcggggatagggtcaggggcttgccgtttagggaagccgtctgctccgagaagtccagaaacaaccgcccgtcgtcgtaaatgtccttggccggtttgtggtgttccagcatggcgaacatggctttgattttccgctgcaaggccccaatcacaaagggctttgtgatgtagtccaccgcgcccacctcataaccccgtatctggtcgctctcctgatcgttggcggtcaggaatattacgatggtgtccgggtgctgaggctttattagcttgcacagctcaaagccgttcccgtccggcaggttgatgtccagcagcactaaatcaaattcccgctggcggatggcgtcggctgcggttctggcatttagggcagaagtcacgccatagccgtctgcggtcaggttataggccaccatcttattcaaaaaactgtcgtcctcgacaattaaaatctgcttcatatcctcacttcctttgctttttgcagatagtataacaggcaaatgtccgagaattgttacaaggacaaatatatttatcattttacagcttttttatgtgtactgcaattttataaaagaaaggacagcagtatcatcaaattgctgtccttgcggtttattatagctggtagtgtataagcgtgggttcatcatatttggtgtggtatctttaactatgggaaactcccgtctcgtatttggaaagtgtctgcctggacacatcaatcttctccgccagttcctcctgcgtcattccacgcatcttccgcagcatcatcagattatctttgaacatgtttcctctcctttttctctccaatcacacaccatcttatgaccggaattctttttatcagctcatagagaagatagccgcccgcataggctgcaattcccgacaaaaggtaggctgcaacccccgtaactttggtgtagcggtccagaaaatatgccgccgccgagagtgccagatagtggaacagatacagtccgtagctctttttagaaagccacgctgtctttcgcgacgtacggttgccccagcgcttcattcctcccaggactgccagacacaccgttcagccatacaaaatggaaaacggactgtttaccaccggctcctctgcataattttccccaaaataataccgcacataaaaaactgtcagcaccacagccgcggttgcaagcgggacgctcacgcacgccagccggtcggtcacttttttatgggaaaagacatagtagcccagaaggaagcagatgccgtatattccgaaacgatacacacagatcaccggcgtattcaagatctgggcagctccccagacgggaatcacaagcagaaaaagaacgggcagcgcagctttttcaccaaacgcatacaaccggtctttttccattccattttttatgctttctgttaaaaatcattgcatttctcttatcatctgttgtacagacagaattccgtcagggattacatctcttgcacggatcatatccggctgcaatcagttcctccctgcttccggagaatgccgccttgttttccggcgacatctgcgcaacactcgagcaggatgaccggtgaaacttctttgtgttcgtattgagcacgtattctcctgtcacgtccgctgtgccgcccgcggcagtctctcccccggatgatgcctgtgccgcgcttcctgcggtatctgccgccccggatgttcccgtggtgtccgcagcacctgccgcgacctcatccccgtcccggtaatcctgcgtcgcgtccacgctccagctaagggaggttccgtcacttgtgaccgtgatggttccctgcagatccgtccggtagagcgctgccccgcatgccttcacccggtcgagtaccgtgcgcgtcggatggccgtaggagttccccgcacccgcactgatcacaaccgccgacggcgacacggcgcgcataaacgcttcggaggaagacccttcactcccgtgatgacttgccagatacacgtccgactccagcgtcacgccggagtcaagcatcgcctgctcttcggcttttccggcgtcaccgcagattaaaaagctggtgtcgccgtacacaaggcggattccgacggaattatcattatcctccttcggatcataggcttttgggcagaccaccgtaaaagaggcatcgccaagcgtgtaagtgtctcccaccgccgggtaggcaagtgcgatatcctgctcctttatcacgcgctcaaacgactcatagactctggtatccgtcacgtaatcgggagcaagcacctgcccgcaggaaaatgcgtgcagggcgccgaccacaccgtttaagtgatccgcatcgtagtgagaagcgatcacataggcgagttcttccacgccctgttccttcagatagcttaccacaaacgaggagtaatccctgttgccgccgtcgatcagcatatacgctccgccctgctccactaaaacggcattgccctgtccgacatccaaaaacgtcaccgacagcgttccgtccggcgtctgtccttcccccggctctgccatctcctctgtcggtgagccgccattctcctgctgctctgccatctgcaattccgacatctgaccatcctgcaaggttcctccggacagtgctgcctgctgccttaccgcctgcccgtccgatgccgctccgcatcccgacagcaaaagaagcagggccgcacaaagtgccgctgccccgcttctgattctgctgctgttatctctctttttcttctgcttccccgctgtctgcatgtcctttttcctcttccataaaatacatgcgcgcagcgaaatcctgaaaataccgcacctcattgttgtatccggttccgccgaacgcctgtttaagcttcactccatgatacattaacatatctccggctacatggcaatcctcgatctccccgtccatcttcttaaatctggcgatcagatccagcgccagcgaatcctgcttaatgtgtaccggggagacggtattgaccagatccccgaaatccttgatattgtattttaagctgcggttatagaaatggtaccgcgcatcgggttttaatcccttcgcgtgatagctgtgatactgggtattcggtacgaccagcttctgcatgagcataccgaccgcacgggtctggtcttccgacacacaggtccactccatctggttccccgcactctgggagagtacactttcatgtgccccctctccgaatgtgcgtccgcggtaaaaccgtcccttctgcaatacctcccgccactgtttgtacagtgcgatctgtgcctttaccgccgcaaaatcctcgcgggacagatcgcagaaattgcactcatagccgcagatgccgaatgccgccacggcgaaccgtgtctcaagcggcgtcacgcggagcgtctggtggttcgggcacgccgacacatgggcgctcacaacggacatcggatagccgtaggaatagccggtctgaatctccgcccggcagagcgcatccgtgtcatccgacgcccagatctgtggaaaataggataaaattccaagatcgaaccggttgccgcccgccgagcatccctcaaagagaatgtccgggaaacgcgcggtaagctctctcatgcaccggtacagtcccagcacatagcggtgtgccacctctccctgccgctccggcggaagcgctccggaatagtaatccgtaaacgtccggttcatatcccatttgacataggagatctccgccgaggaaaagacattcgtcatcgtctcgatgatatagtcctgcacttccgttctcgtaagatccagaatgcgctgattgcgtccctccgcgtgcggttttcccggaatctcgatcgtccagtccggatgtgcctgatagagatgactgttcacattcaccatctccggctccacccagataccgaaatccagcccgagcgccttgatctttcttccaagtcccgcaagacctcccggaagcttcttctcgttgacttcccagtctcccagggaatgtgcgtcatcattgcgctcgccgaaccagccgtcgtccatcacaaaaagttctacgccggcttcctttgccttcttcgccagagcaagcagctttctctcattgatgtcaaaataggctgcctcccagctgttaagcagcaccggacgcaccttgtgcttaaacgctccacgcacgatgtgctcccgcacaaatgcatgcatgcactggctcatgccattgtagccctcgcaggaatacgccatgaccgcctccggcgccgcaaagttctcccccggagccagcagccaggaaaatgactgcggattgatgccggcagtcaggcgcatcttgccgtagccgctcacttccgccgcctcatagtgattgccgctgtagatgaggttgcatccataacactctccggtatcctccgtcgtatccgtctttgcaatcatgacgaacgggttggcacggctggaggaggttcccgtgtaggacgcattgacatgttttcccgcctccatgcgcgtatcggagcggtgcatctccctcgcccacgcaccggtaaaggttgtaaaaacatactctgccggatcaaagtcgatctgggtgctcatcaggcgattcagacggaccgtctccccgctctcattgaagagaacggcgcttcgcacaatcgcatcgcactctgcgtagacatcataatgaagttccagcacaagatcataggaatgatcgcgcagccttacgctgagacgctgcgcctcccccttctcgtcgtaagctcccgggagatctccgttttctgtccccgccgtcttttctgtgatctcatagctttcatagcggaaatccgaagtggtgctgccatccgcgtgcacgatctccacaaacggttcgcggatgtccccttttccgtaggaggacatctcaagccgcatgtcctccagagagaacgccggatgctccccgtcgcagagattcgtatttcccggtgcaaatgtatgcttctccaccagcggagcaacatcacactccgccggatgctcaggcagcgtcaggtgccttccgtaatacagatgctccaaatgccctgtctccattctccggaagcagtatgtcgtatgcgccgtctccagcacaaaaatatgtccgtccgcttttatcatttagtatgcccctttcttgacctgctctgcgatctcggcaaccttctcctccgtcagaatatactttttgtggaaaatgaaaatgccgcacagaaggcagatgatcggaagaatcgtcattgtcatgcgcagacctaccaccgaggatgtggcagctgtcgcaactgctgcggtatctgttgtatcgttgctcagattgcagatctgtaagcagatcgatgcaatcagtgccgccacgccgctcgccagtttgaccacgaacgtctgcatggaaaagatcacgctctcgtcacgtctgtgatttttcagctgtccatagtctacggtattggcaaggaacaccgtcgtcagcactgtcagcacgccgtttgctgcaaagatgaaaaatcccgggataaacagcagtatcacgttggacatattggtgaatgccagtactaaaagcaccacataaccgatgattgccatagcaaatcctgtgtagaacacctggatcgttcccatgaatttgcgcagcagcgggaataagatcatcatggacagaatctgtaccgctccgccgaacgtattaaacaaggtgtagctgttgtaccagccctcgccgccgaagtcatatttaaagaaatagatcacaaggtttgaggtcgtatagaccgcacagttgatgagaacgatggtgatcacgaccgtcatcgcctggtcgttctgaatcagtgcacggaacatctgtcccacagacggagaatccacattgaccgtagatttttccttgacgttgacacatgtaatcgtcgtgaaaagtacaaataagattgcaatgatgagtgcaaaccacttgaatcccacgcgctcatccccgccgccaagacggtatacacataacattgtgatgatcgtgatgatggcagagccgacgcccgcacaggagcgcgccatcgtggaaagtccctcacgctctttaccgccctcggtaaacgccggaatcattgaccagtaagggatatccatcatcgtgtacgtcacaccccagagcacataggtgactgctgcataggccaccagaccgcctccgtcgagtgccggcggtgcagagaacatcaggtagagcatgatggcatttaaaatcgttccgatcaaaagccacgggcggaattttccccatctcgtccttgtcttggcaaccaccacacccatgatcggatcgttgaacgcgtcaaacacacgcgctgcaagtaagatcacgcccattgcaaacgcactcaccccgagaatatcctgataataatacagtatgtaacttgcggaaagcatgtacaccatgtcttttccgactgctccaagtccgtaggagactttttcttttcctgtcagtttcatgtgatcctccaattctgcgccttcgcgctccccttatctcttctccatcgcaagctctaccacacggtaggctccgtcgtaaattcctgctgccttgttcttctcgatgcagtcgcacatatcgttaagcagcgcgtcctcgtttaagaacagatccagcatctgtaccgtgtgcggaatatctctgcactctaacgtgccgtccccgatctctgcggagtggatggcgccccactgctcatgcccgccgacacgcttgataaacagcttcggcaccgggtagaatgccagctcgctcggctttgtcacaagcacatcgcagcttctcatcagaaggttcgtgcagtagactgcctcgaaaatattctcatgccagaagccgtggatgccgcttacctcaccggtaagtgcctgtgcggcaaactctgtcgtatccttccagttattaaaatgctccgttgcaaacttcttcattcccgggatctcgccgagcagctcctcccagacattgcggtaatcaccgacattcacatacagtgcggctctgccgtcccgaatcgcagggagcagatgtttaatgatggaagcaaaaatctctctctgtgctcccgctcctccgattgtgagaagaaaacgcatcggctttttctctctcttgcgcgcccgtctcgtctcacagtccgcctcgatgttgctcaccagctcatggtcgatgtaatgtcccgtatagatcagatcatcctcaggcatcgggcgaagaacgtcagctccctgcatgccgtttaagatgcggtagccctggtaggcgtaatgcgtctgcacggtgtgaatgcttccctccgataaatgcagcgccattggccagttgtccggaatcgcgttgaccacatgcttcattcccgcatggattgccgcctgcgccggccacacgtgtgtcgccaccaccggaatctccttcggcacattcgcatagaccggagccatcagttccgcgtttttctgatccgcggcattgtaggaaagcttccggaagccttcatagttcatcggctcccagaccagacggttaaacagtctgctcttctgggaaagtcttgatcccagggaatacagatcattctgcgcaccaataacttttgtgcaggtcgtctgcgggtaggaattcaagtccatccagtacggtacatagcccatggaatgtgccgcagatgcgatcgccatggaaatgcggtaatgtccgaatcccatgcggatgttgccgacgatgattcccttttccgtgtcaaatcccacgttttctcccgtctctcccacacggatgtcatgtacgtccagcatatcgccgatgtattcattcttcttcacgattgcaggataatctgcccctgcatcgtccccgaatttttttgcatatttctttttcgactttaccgctttccggtataccttatccggcatcggattgccaaaaataacttttgatttttcttccattgcctgtgttccctctcttctcttacaatctctgtcgctctgccgctgccgcaaagcgcagttccaccggttcggtctgtgcattccggatgacaagccgtgcctcaccgctctcacccgtcgtctttatataagtgccgcccattccgccctccagcgagatgacggacggtccgatcagctccaccggtccgctcacctcaaagcttaccggctcattaaagaagctaagcagattgccgtattcgtcccgcgcctcaatccggatggccgccacatcgtaggtgcttttctcctgaagtcctgtgtgatccgcccgtgcaaaaagtacaacctttgtcatcggctttttgatgagttccgcagtcacgccgccgtccgacaccgcctcaaaccggtatgtcgtggaagtgcctccccagtctccgatatagcggttatagagcaccaccgcatcggtcggcttcatgtgataaaggagcagcatcttaagcgccgtcacatacacggatttcggaagatgcgacagtccgtagcgtgcggtcgcattcaacgcatccttgattccctttccctgcgccgttgtaaaatgttcgtccttctcgatcgcatctccgatataatcgtcgatcacgagcggtccgtgcggcagatgtttccacggggaatcctctctcttgtattccttgataaaacggtcgtttttgtacatccgcacactgtctgcgttggtaaaaatgtaggtctcgccgcggttgcagcccgggtgctcccctatgtccatggaagaactcagttccagaaccgtatgctcctcctgctggcattcatagaccctcgccgccagcttcggattgcggaacatatccatcacgccgtggtaacagatgcggtctccgctgccgaaatccttgtgtgtgttgtagtcgaacatgcaccagccgaagcttcctgcaatgtcaccctccgcagccgccgcgtcgagcacccgcacatggcgcagcgcatgttccgcgcggtgttcctcccagtcgaatgccttggtcggatacatgtggccattgtactcgctgatcagatacggctttttcggatcggatgtcaccgccgcctttttctcacatccctggttcgtgccgtcatgcacaaaatcattgtaagtgtagacgtcttccagaagactgctctttttgtgcgcccgcacaccgcccgtcggtctggatggatcgagttcgtgcgccgccgcgttcgtcctgcggtaaaaatcatcatcgtcctgcgactcgttgatgcgcacgccccagagaatgatggacgtgtgattgcggtactgcatcaccatatcgcgcacatttataaccgcctgatccttccacgcctcatcgccgatgtgctgccatcccggaatctccataaataccagaagtccgattctgtcacactggtcgataaagtaatgagactgcggatagtgggatgtccgcacggcgttgacgccaagctcatactttaaaatatccgcgtccatccgctgcatggattccggcatggcatatcccacatacggatagctctgatgtcggttgagtccgcggagctttacttttttaccgttcagataaaaaccgtccgccttaaactcggcatgtcgaaagcctgtgaccgtcacattttcatccagcaccttttcatcctggatgagctgtgtgcacacctcatagcagaccggatgaacggtgtcccacggcagaacggattccaccgtatagtcgagcacaagctttgttccggtcagttcacattcgcccagaagacggtagccgctctcgccgcatcttttgatcttctgtctgacgctaagattctccccaccgccttccgccgtaatctcggagatcagtctgccggagtcaccggaaagatctccccgcacaaacacatccttcagataggttttctccttgatgtcgagccacacctcacggtagagtccgccgtatgtcatatagtcaatcacaaatccaaacggcggtatattcacgctctccctgctgtccaccttgaccaccagcgtgttgcggatgccgtagacggcatcgtcgctgatgtccatcgtgaatgccgtgtagccgcagtgatgttccccgatcttcttcccgttccagtagacttcgctctcatgcgccgccccgtcaatcgtgagcagcagacgttttcctttccattcttccggaatatagacatctctgcggtatccgctgaccatctggtaaacagattcgtcaaaatagtgaagcggtgtctcctttgccgtgtgcggaagccgtaccggaatcatgtttcccacgtcaaagccgtcgcctagcatttcttccgtaaattgctccgaaaacttccagtcgtcatttaaatatactctgttctccatgttctacctttgcctgtcaccttcctgcattgccacgcgtttatcccgccgcctccggcaccacaattccgtttaccagaatcgaaaccacctcatcgagcgcttccagataggaaagcccgctctgaatcaggatatctctctggaaaaactgttctaccgtggcctccagcatcatctttacgatcggaatgctgaccttgcggaccacgccttccgccattccctgctccagaagctggatcgttgtctcccagccggtctccagtcttttttccacctgcttgtagatcaccggatacttgtcctttaacagatagagctgtctgaaatccacatcccggtaactctccggaatcactccgagaatccgtctgatcttctccaccgtagagagcgcgtcatcctccacgatctgctgttcactctccttgatggaatcgaacatgtaatccaccatcgcaagaaacatcgactccttgtcgcggaatacggtatatatggtctttttgctcattccgaggattttcgccacatcgtccatggtgaacttcaggcctttctcattaaacgctttgatcgttccctccaggatcacttctttctgctgcatctttagccacctccctcttttggaaactatttttatttttctggtttcctttattctatcacgatttccaggttctcacaagaaaccgaatttacaaaatcagtttccattttttgtataaatgtactaaattccggtctttcaagcgcctgcgcgttcttgcaatcccgccgtacaatgggtataatatggttaattacagacatggaggacatcatggaaaacgatcatatcagaacgattcttaataatattgaaaacggaacgctcaccgcgagcgaagcctacgcgcagttaaagctggctccttttgaggatctcggatacgccaaggtcgatcatcaccgcgaagtgcgtcagggagcgccggaagtgatctacggagcctccaagaccaaagaacagatcgagggcatcacgaacagtctgctcgcccactgtccggagaatatcttaatcacgaggctttccccggaatccgctgcttacctttccgagcgttttacgctgttctacgatgaggcgtcccgcatcggcattgtgaaccgtacgccgcatatcacagcggagggaaccatcgtcgtagccacaggcggcacgagcgacattcccgtcgcggaggaggcagccttaacggcagaagtgctcggcaacaaggtcgtacgcgtctatgacgtcggcgtcgcgggactgcaccgcctgctctccaacatggagctgctctcatccgccaatgccatcgtcgccgtcgcaggcatggagggcgctctcgccagcgtcatcggcggtctcgtggactgccctgtcatcggcgttcccacaagcgttgggtacggcgccagctttcacggcatttccgcgctattgtccatgctcaattcctgcgccagcggcgtatctgtcgtcaacatcgacaacggcttcggcgcgggctaccttgcaagcatgatcaaccacatcggcggctgatcacaccatccatcactctaacaggaggtttcttctcactatgaaaacaatttatctggaatgtaatatgggtgctgccggagatatgttgatgagtgccctttatgagatctgcgatcagaaagaatggtttttgcacaagatgaacaccgtctttgccccttatcatatcgtgctttctccggaatccgccgtaagctgcggtatcaacggaacccacatgaaagtaacggtggacggtaccgaggaggtctctctcgatgtcaaggcgggacatgcccatcacacgcatgcagagagtccggatgcatcctttgcccacgaagcgtccgattctgcggaggacggacactcccacacgcacaccacctacgccgccgtctgcgaggagatcgcatcccttgatcttcccgcagaggtaaaggacgatgcgctcgccatctaccgcctgctcggagaggcagaagcaaaagtacacgacaccacgttagagcagatccattttcacgaggtgggaacactcgacgcactcgcggatgtggtcggctgcgcgcttttaatccgcacgatcgcaccggagcagattctcgcgtcgccccttcacgtcggaaacggctttgtaaaatgtgcacacggcgtgctgccggttcctgccccggcgaccgcagagcttctgcgcggcattccgttctacaccggctccgtgaccggcgagcttttaaccccgacaggtgctgccatcctgcactactatgtgctgcgctatctcccgatgcctaccatgaccgcgtcggagatcggctacggcatcggctcgaaagatttcggcatcgcgaactgtgtccgtgcttttctcggcgacaccgcctcctatctcgctgccgaggaggaggagccatactcctgcgacgataccattttatcgatctcctgcaacatcgacgatatgaccggcgaagcgctgggacttgcaacggagatctttatggcagccggggcactggacgtctttacaatcccgatccagatgaagaaaaaccgtcccggcattctcttaacctgtctgtgtgagatggaggaacgtgaaaaattcacagggcttttcttcctccatacttcgaccagaggcgtgcgctaccaggtgttcgaacgcgcaaagctggaatctacttttgagacgcgcaagacctcgtacggcaatatccgcatcaaaaaaagttccggctacggcatccagaaggagaaagcggaatttgaggatttaaaatccgtggtcttaaagaaccactgcgccctctctttgaatgaaatcgagaaatccctgcactaaaaaacgtgcgggagactgcacataccgcagtctcccgcacgttttttgtgtactgtaatgaatcccagtctacagattttcctcttcgatcgtaagcatcccggatcttaccgcaagttccacaccggggcacttttccttgtactgctccatcaaaagcagccagagctggtgaatgtgatccgcaagcaccgccgacatctccacactgtacggcagtaaggtgtgaaggtcgaaaaagcggattccctccggcggcagaaagaccagattgcttgagcgctccttatccccggatttcttgagcagctcataggtaatcatgcagaattcttttccgcggtagttacagctgtaagacgcataacactcatcaatcgtccactttgttccgtgctcctcctcgatcggcttctcggaagcatcatttccctctgtggtctgtacttccagtctccaggaaagcttctgtgcttttgtctccgcaatcatctccgtcagtttacggcataattcttcctgtttcatttctctacctccgtattctcccagcggactgccttcgccttctgcaatgcttccggccgctgtgccgctaccgccgcttcatccgacgcatggcggtccagccagtctgcataatacccgacagcctcttttgtgctgtcaaactgatacagcaggggcttcctgccccagtccgccacatagacccggttatagtccagatacgccgccaccgccgtctcaccggtgtcacggtgcctgtaacactgttccatcaccggttcgccctgcacttctttcagtccggcgcctttgatcttctgctcgagttcttccaccgaatcaaacagtgaaaataactcaagctgtccctcaacattcttccctgccatagccttcctcccgcacaagcccggatcagccccagattacgctctcacatagatctcggacaaattgtccagaatctcgcccgcgacatccggcttattcatagtatagatatgtacgtgattcacgccgttggcaatcagatcgataatctgatccgtcgcgtaagcaattccggcctggcgcatcgccgccggattatccccgaaacgatccacgatcgccaggaaacgcggcggaaccatattgccggaaagcgacacgatcctcttgatctgcgccttgttcgtcaccggcatgattcccgcaaccaccggcacatcgatgcctcttgagagtgccttgtacaggaaattgtacagaatgtggttatcaaaaaacatctgtgtcgttaggaattcacagcccgcatccactttttccttcagatgatccagatcctcaaaaatggtgtccgcttccggatgtccctccggatagcaggcgccgccgatgcagaaatctccctgtgctttgatgtccgcgatcagctcactcgcatgacggtactggttcggaagcgggaaatccgcattctgcggaatgtctccccggagcgccagaatattgctgatctgcttctcttttaactcctcaatcacggatgccaccttttccttcgtggaggaagcacaggttaaatgtgcaagcgccggaatctgatgcttttccacctcgctggcaagttctaccgtatagtcggacgtaccgccggtcgcgccgtaggtcacgctcatatatgccggcttcaatgccgccatgtccgcaacgatatttttgtaattggcaagctgcgccccctgtttgggtggaaacagctcacaggaaatcgtaacctgatcggtctttaataattctgtccgtctcatctgctctatcctttcttctgcgtcatgcctaaaattttctcagcttgtctgttccgtcatccacggtattctcgatcttgcggattgtgacaaaataagaataatcatcgttgacccgcacttccacgcgatcccctacccggtgtccaagcagcgccttaccgagcggcgactcattgctgatcaagttcttgagtgaattgccgcgcacggtggtgacaatcttatagacttcttcctcatcgtcctcctcgaaatacacggtgacggtgttattcattccgacttcgtcctccgcggaatccgtagatatgatcttcgctgtcttgatcatcttctccagataacggattctgctctcgttctggttcttgtctttttttgccgcatgatattcaaaattctcgctgagatctccctgggctctcgcctccttcacagcctcgagtgcttccttgcgcacaaccagcttgcgatactcgatctcctcttccattttcttgatatcctgctctgtcaattcatcgtacatgatctatccccatcctttttggctgatgaatttattatagtgattttaggaaatgccgtcaaataatttccgcagatcaacgttctgcacaggacaccccgtgatgggatgtcccgtgcagaacgacaatacataatcttttgcaaatgcttctgtatacaaataaaagtccccggcatccgcctccctgcctaccgtctctgtgtccgatgcttcccggcctgccacctgatcctccagcacatcaaaagaagaaagcggcaggtgcagtccttcccctaccgctttgcaatagctttccttgcgcgtccagagtcttaaaaacgcatccggtttgctccgcagatacgcattctccgctgccgtaaactgcctttgcataacattcacattcacgcgccgcgcccgttccacgtcgatgccaaccgcgccgtcgtcaaataccgccgccgcatagtctcccgcgtgggacaggttaaaatgcacccccgtcccgccggaaagttccggctttccgtaggcaccgcgcaccagatgcaccgtctctgtccctggcaccagcggaagcagggaacagccaagacttcgcagaccatactccagcaacaaacctgcgccaagacttctcctgcgatcctcctgcttcccgcagcgcgctattttctcctgtctctctgcgggtacataccgcagaagctcttcgtacaatgccgcatcccgcagcggcgaaatattggttatcagaaccctcatgccgtctcctttaacagggtattcagcctgtctctcgccgccagaagttcgtcgcaggcaggtaaaagtcccgccgtctctcccgcacgcagcggttccacaatccgcaccacaatatcatataacggggtcagtcccatattggcaagcattccttttaatgtatgcgcacattcaaatgcacgccccatctcccctgagcgcagcgtctccggcagaagttcaaaattctgatctgtcgctgccgtgtacaggcagcggcggtacagctccctgtcaccgatgaaccgtgccagcgcaccgtccacatcacagccccagtttttcaaggaatcaaacagttcctccattgtccgtctctcctttatccttctctccggcaacagacacccgcttcaacagtctgccagctcccagaacattttccactctgcgcatcgcaatctccggcacgaaaggcttcacgatgtagtcctctgcgcccagctgcagcatctggatctgatgtccggtcgtgtcgtccgctgtgatgataatcaccgggattcccgcaaggacggcatcctgctgctttcgctttaggaattccattccatccatcaccggcatcgcaagatccagcaggataatatccaccttgccggactctctgtttaagacctcaaaggcatccgctccgttttccgcttcaaggatccggtactgttgctcaaaaatgcacttaagcagtccgcgatttacctcctgatcatccacaaccagcatcgtccgctctgtcttttccgctgccagaagtacctgacggtatttctgcagttcctgatccatcatccgctgttccgtaatatcggtaagcgtaccgacgataatgtgcttttcgcccacgctcgtgatgtatttcagcttcagatgtacccagatcgagcgtccgctcttagaagtgcgcaaaaattcgcaggctgcggtctccttcgactttgcaatatcctcaaacgtgccgaggagaatcttcctactctcgtccgagagttgtttttccatcacaagcccgcccgaggaattgatatctccgtatccgaacatgtcatagtaggcgttgttcacgcggagtgtatcaatccggttctgctctttctcatattcatagatgaccgccggctccatcatgccggaaaatacgcttcccatctgtgacgtcgcgttccagagcatatccctgccgatctcgtccttctggtacttctcctgcagttcgtcctttttctcggataccagcttttcatagtcggataccggcatcggtctcgcaaaataaaatccctgtacatactcgcatccgacgctgtgcagaaagtccacctgctcccttctctctacaccctccgcaatcaccgggagattcagccattttgccatgcgcacaaccgacgcgagaatattctggctacgcccctcctgatccgtatccgacagaaacttcatatcgatcttgagcacatccacggcaatatcctttaacacatttaaagaagaatatccgcttccgaaatcgtccatcagaatagaaaatccttccttctgcagacgttccatcgtctccttgatcgccttcgggttcgtcgtgtaggcgctctccgtcagttccagttccaacagttcccgggggatgtggtagcggtccgtcagtccgcagattgcctccaccagtcttggattatagaggctgaccctggaaatgttgaccgacaccggcgacggctttttcccctcggcaatccatcctgcaagcagcttacaggtcttctcccagacgtagtaatccagcttggtaatgaatccattgcgctcaaagaccgggataaattctcccggcgagatcatgccgccttccggctttgcccaccgcaccagcacttccgccccacagatcctgttgtcctgcaggctgtacttcggctgcaggtaaaggacgaattcctcctcgtccaacgcatgccgcatatggttgacaatctgctgttcccgcacgatgtcttcccgcatctcatccacataaaacgcatagttttcgatgtaattgcctttgcactgcttggcagccagattcgcccggtcatacatcgcatcaacggagagatcccgctcccggatcacatagattccgattgccggcaccacatcaaaagcgagctggtactgtccgagacgcatgcgcatgtagcgcacaagctctaacatcgtctcctcgcccctgtacggcatgcagatgccgaaaatatccgcctcgattcttccgtaggcaatctgttccgtatctcccgcaaatttccggatctccttcgcgatatactgtaaaagtccgtcaccgctgctgcttccgaagaaagaattcaccagttggaacttttcgatgtcgagacgtaaaaacgcatacgtctcttcgggatgtctcttaagcagaacacgggttgcttcaaagaaatgcgtcttattataaattccggtgagcatgtcgtaatccgcacggtatctcaattctctcgacagctgctgttcactgctgcgcaccgcattttctacccggaaccgcacgatctgcggatcatatggttttcctataaaatctcttgcccccagtgccagacatgccttttccgtcttgacgtcacgctccacagacgccacaatgaccggtatccgacgataagaatccaccttgcggtattctcttaaaaattcaaacccatccatctgcggcatgaccagatccagaatgatcgcagatatcgcgtcaaactccttctgcgattccagaatccgaagtgcacctgcaccgtctactgcctctacaatctcataagcatcctttagcatctttttcaatgcgatccgatccagctctgaatcgtccactatgagtaccttatctctgctgcccatactcttaccccggttttttttattctcctggttcctatccgattcgtcctatattcctaatctgcattcgtcatcaaacgcatcataacctcacttcatcatagcaaagttaccgccgcatttcaatacttcgggcaaaagaagcaggaaaaaagccctacccgctattgcggcttctctatgacagcaatcgcctttttgaactggaagaaaaacagaacaagcgtaaagcttaccgcgatcacatccgctgccggctctgccagatacacgcccatggtctgatttttcaccagatgcggcagcagataaataagcggcagcaacagcacaaatttacgcataatcgccacaatgatcgaagcccccgcattgccgatcgagataaatgtcatctgacatgcaatctgcgccccgaaaatacccatggcggcacagtagatgcggagcgcccacttcgtgtatgcgatcagctctgcgttggaggaaaaaatcattgcaaacatctgcggaaacagcatgattaaaagccataccgccatcgaatagcacaggcttgtggtcaacagcagacggaatgtccttttaacgcgctctgcatttctggcgccgtaattgtagcttgtgatcggctgggcgccctgtccgagtccctgcatcggaagcatggaaaactgcatcgcactggatagaatcgtcatggctcccaccgccacgtctcccccgtatttgagcagcgaggcattgaagcagaccgtaatcacgctctcgcttgcctgcatgataaacggggcaagtccaagcgccagccccggaagtaccacgcccgcttccatgcgcagatactttttgcggatttttaatacagtcttttttcccgtcaggaatgagagaacccagacggtcgataccgcctgcgagatcaccgtcgcggtcgccgctccgcggactcccataccgaatccatagatcagaaccgggtcgagcacaatattgcagcccgcgccgatcataacgctgagcattcctgtcctggcaaagccctgcgccgtgataaacgcattcatgccgagcgtcagctgcacaaagaccgttccggccgcatagattttcatataatccgaagcaaagccgatagtattctcacttgctccgaacgtcagcaacagcggtctgtaaaacagtaacagcagaaccgtgagcacggcggagatgacaatctgcagtgcaacgctgttgccgagaattttttccgcctcgtcatagtcgccctttcccatcgccatggaagccctcggtgccccgccgttgctcacaagtgcggcaaatgccgacacaatcatgataatgggcaggcagacgcccacccctgtaagtgccagcgccccatcttccggcatatgtccgatatagacccggtctaccaggttatataacaggttgatcagctgtgcaacgatcgctggaagcgacatgcgccacagcagtctcccaatcggatctctcccgagaaaatcatttttttgttccatatcaacggttcctcccatcatctgtctgtatcaaaaaacatctcgtccaaatataattcgttgaatttcgggtgcatggcaagcgaaagttcctgtgcgcgccctgtgatagacgcaagcctctgttttgccgccgtcctgtcgtcgagcagataccgctgtgctcccgcaagcgcactgttgccaatcatcgtgatatgtccccggaattgttccgggaacagtccgatccggatagtctgctcctcgtccatcctgcagccaaaacctcctgcgatcaggatttcttcggggtctcctccgccgtattccgcgagcagcgtctcgatccctgcgcggatcgccgccttgcccatctgcacctgtctcacatcctcctgccggaaccggaatctgccctccgcgaccggcatgccgtccgtaaaccagggttcctcaaacgtcccgttctcatcgatgagtccgagccgcacggcttctcccacagcgtcaataatcccggttccgcataagccgatcggtgtctcaccagcgatggtgcttaactccacggttcttattcctcctatggcggcaggatctctctccagaaccaggcttgtcacggctcccggaacgcccgcaacaccgcaggatatattcccgccctcaaagaccggtcccgccgctgcggaagtcacaagaaatccatccgctcccccggctgccatctccccgttggtgccgatgtccagcagcaacgcatttttcttccggtccatttccaaggcatagattcccgccacgatatccgctccgacgaaagcagagattccgggcaaaatggtcactgacacactccaccggtcagacagtgcaagctctgcatcgctcccctcccagagagagagatcctcaggcgtaaaaggcgccgctccaagccccgcacaggataatccgcgcaggagatgacacatggtcgtatttccgacaatcacaagttcctccacagcatcatccggtatcccggcatccgccacgagtcccgcaagcagcgcatcaatatcccggcagatgctaaggcgcagttcctctgccgccccctcgtttgccgcctggattctggacagaacatccgcgccgtatgcccgttggtgatttaccgaggatgcggcggcaatccgtttcctctctgtaaggtcataaagcgttgcagcgagcgtggtggtaccgatatccacggcagcgccgcagcgctgtttcccggaatgcccccatatcttggctgcaccctctctgttgtgcatcgccgcgcaatctctctcaccagggatggctcctgccgtctgaccggtattttccccatccgctgcatccgccgtgaccaacacatcaatcttctgctcccggcttacgggaagctgcaggctgcatgcctctgccccgcacacttcacacgccatgcgcacgccactgcttcgttcttccgctgtgagcagcctccgctcatttgccgtcggttgtggtgcctccgacacaaagcgcacgcggcatcttccacaggttccctttccgccgcagggcgcatccacataatgtcccgctcttatcagacgcatcagcagcgtctctgccttcccgcccgatcctgccggaagttctatcacttcttttgcatattgaacgttcatccagtcattcctccccgcgttatggcgtgtagtccacgcctgcccgcctcgcctgctcttcctgttcctcctccgcgatccggtatatccggttccctttccggaaaaaagtgccggtccgcaaaaagcggaatgtaaccccgcagttcacgcactggttcatcagttccagcgcccaggcaaaatcgcatacacgcgcgtctgctccctgttcgccgccgcagagaacctgcgcaatctccccggtctttagatacgcatccagcaccagtttttcaaggagcggttcgcagagaattcccttatggcgcaccggcagttttaaaaatgcaggaatccggtcatccgcgcgtctctgaatctccaccgaacagagaatcgtcacgttttcatagccgtctccccagtcgccgggcagtgctttaaaaaagcggtgctccctctttgtctcaatcacaaaggaaagatcctgccgctccttgatcatcgcccacgcctcgctccgccattcatccgcctccggcaggaaaaaatccgacgtcatgcacacatagaccggttcctcctgtggcagcagcttgtattctcctctccggttcttctttaccggcagatcaaaattggctgtccttcggatcacggacgcatttttgccgtacatcgcatctttttcatatacataacagttgtcgcaccctgcactgattttcttgcagccatgccagggattccagaccgccatacgaaacgcgcctccttcttctttcctttttgtccgccggatggtatacttatcacaaatctggaaaaagtaaaaccgctgccacatccgggcagccacagaaaggaattgtctatgaaactgatctcatggaatgtcaacggtctgcgcgcctgcatgcagaaaggcttcgcagaattttttacagcaagtgatgctgatattttctgtatccaggaatccaaactgcaggaggggcagattgattttgcaccggagggctattacgcttactggaattatgcgcagaaaaagggctactccggcaccgccatttttaccagaaaggaacctctgtcggtgcattacggcatcggcattccacagcacgataccgagggacgtgtgattacgctggaattcccggatttttatatggtcacctgctacacgccaaattcccagaatgaactggcaaggctctcctaccgcatggagtgggaagatgcatttctctcatatctaaaaggtcttgaccggaacaagcctctgattctctgcggcgatctcaatgtcgcccacgaagagatcgaccttaagaatccgaaaaccaaccggaaaaacgccggttttaccgacgaggagcgcacaaaaatgacggctcttttatccgccggcttcaccgatacgttccgccatttttatccggataccgagggcatctactcctggtggtcctaccgctttcacgccagagagaagaacgccggatggcgtatcgactacttcatcacctcatccgcactcgatgaccgccttgtggatgcaggaattctcaccgatgtcactggctccgaccactgtccggtaacacttaccgtcgatctgccattctgtccatagcactatttctgccgatagacatgacagtaaagcacgtcccgcatggtctcaaattcatccgccaaaagccgcttcggataagacatgatccgaagcgggatggcatgtctgtcctctcccatcgccggctgcatatattcaaacggattcatcacgaatctgtttctctcataaaatgcaatccgtctggcttccagttcaccggtcggcagttccacctccagtataaccggctttctgctctgcgtcgtcagctgtgtcagaagtaccgctccaagtccgccgtttcggcatgatttcctcacggcaaagtgctccacaaacaggaatgtatcaaactcccacactgccagaaacgccatcagttccccatgtgcacggtacccgtacaggtgataccaggagacatccagtatctttctctgcgcctccctggatcgtctctcgtcccgcggaaaactctcctccataatctcccatacgctgtcaaaatcccgttctgtcagtgtctctaaactctgcatgttctctctcccggctgattctttcttacttacttttataccataaaacaagattatagcacaaatttcctacggaatcaaaccgcgctgttctttgcctgcgtctcaccctctccgatcctgatggtgcggaagccctctccgtgcacttcattggactccaatataatcataaacgatgccgggtctgcctccttaacagcatgctgaagcagatacatctctttgttgttgcacacgcacatcacgacctgtttgttgtcacagcggtaaccgccctgtccctgtaatatcgtagagccgcggccgcagcaggaatcgatcacatcgcagatctcctttccatgctctgtcacgacaagtgtcattttcccggaattgatgccgtacatcagcttgtcgaccacgattgccagcagaaaactcacaatcattccgtagataattccatccacatcccgaagcagaaatccgcccagaagaatgatgatcacatccgtcacgaacgaaattttcccgacagaccagtatggtttcagattcttgactgccataataataaagtcggaaccaccggtcgaggaattctgcatgtaaatcaccgcatatcccagtccggcaaacacaccggtacagagtgccgcaagcagacggtctcccgagtaaaccgggagcagcggcgcaacatagtcaatcatcagagaagaaatcagcatacagcgcagtgagctgaagaaaaaatgtcttcccagcagacgatagcataatattgccaccggtatattcagcagtatcgtggaaaatccaaccggcacaccgaacagctgatataaaatgatcgagataccggaaaatccggtcatcggaaatcccgcctgcaccgcaaaattgtaaataccgccagcgataaacgcacttcccacaacctcccagaatatctgttttaaaaatatctctctatcttcttttttcattttcattcatccttcctttgcatgcgagtgtctccacaacacaaaaaaagagcaccagcagattatacgaatataatatgctaacgctcttttccgtatcctattgtaacaccggaatccggaatttgtcaaatatgtttctctttacaatccgtatgtgtcgtgttaatatacttcacatatgaatcattcatatttgaagtatatatatatgcaagacatatcaatatgaatattacatgcgtgaagtattattttatcccattgaaaggagcatttacctatgaataccggtattgaatttaccatgaaactatcggctgcctacagtgctgtatgcagacctttgtgtcacgaactgaatctcccacagaccgcgttcgatattctgatgtttctggcgaacaacccagaatataccaccgcacgcgatattgtggaagtccgcaagatcaaagccaacctcgtatcgatcaacgtagacaagcttgtcggtgaaggttatctgcggcgtgaggcggacacagacgaccgcaggaagacccatctgctctgcacagacaaagccggcgctgtcatcgaacaggggcgcacacttcagaaccgctttatgaacagtcttctggcgcacatcgacgacgctgccagaaagcagctcgcagaaagtattcaccagatggagcagaatctggatcacatgttagaggaggaacactgatatgacattattattcacgatactcgtcaccttttttgccggcatgggcgccggactcggcaccggcttcgccggaatgagcgcagccgccgtcatcagcccgatgttaatcacttttctggatgtcgacccctatatggcagtcggcatcgccctctcctccgacgtgcttgcaagcgccgtctccgcctacgtctatggtaaaaacaaaaatctggatatccgcaacggagtgattatgatggtgagcgtcttaatcttcaccgtcatcggaagctacatctcaagccttgtcccgtccaccaccatggggaatttttccgtcttcatgacgtttcttctcggcatcaagttcatcgtaaaacctgtcatgacgacaaaagaatccatggcgcaggtctccacaaaaaaacgtgccatccagtcggttgtctgcggcgtgatcatcggatttatctgcggtttcatcggtgccggaggcggcatgatgatgctcttaattttaacctctgtgctgggctatgagttaaaaactgcggttggcacgagcgtatttatcatgactttcaccgctctcaccggagccgtgtcgcactttgccatcggcggcgctcccgactggacaatctttcttctgtgcgtggtgttcacgttcctctgggcgagaatcgcatccgtattcgccaataaggccacaccaaagacgttaaaccgtgcaaccggtgtcattcttgtagtccttggcatcgtcgtgctggcgttttccttgttgtaaaatctgcaaaatagcagataaccagaatatgcttacaaatatgccgaccggacgctggcagcttcccaccgccgccagcgcccggttccccgcaaatctcccggtcacagccatacctgcctgacatctttaaattcggtgccgatcatccagtctctcacaattcttggaattctccacgcataggccggtgttacaacaagaagatatcgtcctgcagggcattataaaacctgagacgtacaaatacaagagtgcgcaacgccagcttttgtacaatccataatcattttctcacacatctcataccccagcctggagctgttcatagacagtgtataattgcccgccattccccatttctgctccgtgtaaaaacgataatttgtcatacgcctcttatcaatatccgccatcattttagctgcctcgccttcgttgacatggtacagtctgcagatgcgctgcactttttccggcatatcgccgtgtataaatacattcagcacatcctctctgtccttcaaaataaaatctgcatttcttcctataatgacgcagctctccttttctgcgatctccagaatcacctttctctgcgcttcgtacaccatatcttccacggattttccggtaaggtcgcgtccggcaaaagcatagccaaacaaacccttctttggagagagttccgcattttcctttatgtactccgtagaaaatcctgacttctctgcaatctgaccgatgatatccttatcgtaataggcaattccaagcttctttgccacttcttcgccgataaaacgaccgccgcttccgaattctctgctgattgtaatgattctttttgccatctcaattcctccctaacttaaacgctccactttattttttctgattctctttaaaaatacatagcccaccagacacgctatcatctccgtgatcggaaatgcccaccagatcagtgagatgcccatctgaccgtttcttgcaaagattgaaaaaattcctgccagcggcaatatgatgacaagctgtctgagcagcgaaatcaccagtgactcgatacctccgtccaaagcctgataaatgccctgatatgccacattgattccggcaaagataaagctgatggagataatccgcatcgctccaataaaatattctctggattgcccggcattaaacagtgtcgcaaatgctcccgggaacacttccgtgataatgataccaaaaatcatcagcgccgttgtatacaggagaccatattttattccgtccttgattctctttttgcttcccattccataagcaaaagcaataatgggtgtaattgcatctctgagtccgaatgctaagaacaacacaaactgctggactttatagaacagtccgtatgcggtctgtgcagaagggctgaacttcagaatcaagttcatcacataaaccatgatcgacatcagcgcctgcgcaatgattgccggaagtccgatcgcatagatttcttttatgataccggcatccggcttcatgtactccactccatgctcaaattcctgattcaatttcatatggaacaaaaacagcaataccgcagacgccacctgaccgatcaccgtcgcgtaggctgcgccttttactcccatttcaggaaccggtccgataccatagatcataaccggatcaagaatgatattgatcacggctcccacaacctgaccgatggtcgaatataaagaacgtccggttgcctgcaataacttttcaaataaagaaaagaagataattccaaaggaaatcacgcagcatattctaagatagcttgttcccatcgaaattacttccggatcaaccgtctgtgaggaaatatatgccttcactccggcaattccaaacaacaggcatactgcataaatgattcctccgaggaataaactgttgcctgcaaccttcgctgccttttttgtatttccctgcccgagtgtccttgccaaaagtgcatttgtccccacacccgttccgattccaactgccaccataagcatttgaaccgggaacaccagcgtaagtgcatttaatgccgcctcactccccactttcatgtttccgacaaaggcgctgtccacaatattgtagacagcctgcaatgccatggataagatcatcggtattcccatctgcaccataagcttctttaccggcatttccttcatcttgttactctctgtcatataatcctccttgtttttccgcacaaaaaaaatgtgtacctatctcataagctggacttacgctgataagctacacacttctttatggcatgatatttattttaaaaacagaaaaacgagtagcaaaactggatttacgctagtctgctactcgtttgatccttattatatttctcattttagaaaaagtcaatatagcaaaagcgcaaaaggacagccacacacatacatgtgtgactgtccttttccctatctatacattaccttctcctaaaaataacgcatatgatttatttgtttgcgattgctgcctgtgctgctgcaagacgagcgatcggcacacggaacggtgagcaggatacataatccagaccgatcttgtggcagaactctacggaagaaggatctccaccgtgctctccacagatacctacatgaagcttcggatttaccggcttgccaagcttgattgccatatccatcagcttgccgacacctgtctgatccagttttgcaaacggatcgttctcgaagatcttggtatcatagtaagcatttaagaacttacctgcatcatcacgagagaaaccgaatgtcatctgtgtcaggtcgtttgtaccgaagcagaagaaatcagcctctgttgcgatctcgtctgcagtcagagctgctctcgggatctcgatcattgttcctacttcatactcaagctttacacctgctgctgcaatctcagcgtcagcagtatcaacaacaaccttcttcacatactttaactcttttacttcgcatacaagcggaatcatgatctccggctttacagtccagtccggatgagccttctgtacgttgattgctgcacggataacagcctttgtctgcatctttgcaatctccggataggtaactgcaagacggcatcctctgtgacccatcatcgggttgaactcatgcagagaagcgatgatgttcttgattgtctcaacagacttgccctgagcttttgcaagcttctcgatgtcagcttcctctgtcggaacgaactcatgaagaggcggatccaggaaacgaatggttaccgggcagccttccagtgcttcgtataacttctcaaagtcaccctgctgatacggaagaatcttatcaagggcagcttctctctcctctacggtatcagagcagatcatctcacggaatgcagcaattctgtcttcctcgaagaacatatgctctgtacggcaaagtccgataccctcagcgccaagctcacgagctttcttagcgtctgccggtgtatctgcattggtacgaacctttaatgttctgtacttgtcagcccatgccataacacgtccgaactcgcctgcgatggtagcgtcaacagtcttgatctcgccatcatagatattaccggttgtaccgtcgatggagatccagtctccctcatggaactctttgccggccagtgtaaacttcttattctcctcgtccatagcgatgtcgccgcatccggatacacagcaggtacccataccacgtgcaactacggcagcgtgagatgtcataccgccacgaacggttaagataccctgggaagccttcataccagtgatatcctccggagatgtctcaagacgtactaatacgaccttctctcctcttgcattccaagcctctgcatcctctgcagtgaatacgatcttaccgcaggcagcaccaggagatgctccaagacctttgcccatcggtgtagcagcctttaatgcagcagcatcgaactgcggatgaagcagtgtatcgaggttacgcgggtcgatcatcaatactgcctcttcctctgtcttgtgtccctcatctacgaggtcgcaagcgatctttaatgcagccggagctgttctcttaccgttacggcactgtaacatgtagagcttcttgttctctactgtgaactccatatcctgcatatcatggtaatggttctcaagagtctcgcaaacctttaagaactcagcgtatgcctccgggaactcctgctccatctgagcgatcggcataggtgtacggacacctgcaacaacgtcctcgccctgtgcattgattaagaactcacccataagcttgttctcaccggttgccggatcacgggtgaatgcaacacctgtaccagactcgttgtttaagttaccgaataccataggcattacgttaactgcagtaccccaggaatacgggatatcgttgtcacgacggtatacgtttgcacgcgggttgtcccaagaacggaatacagcctcgattgcaagctttaactgctctacaggatctgacgggaaatcagttcccagctgattcttgtactcagccttgaactgctctgccagagtctttaagtcagcagcggtgaggtcgatgtcgtactgaacacccttctcctctttcatcttatcgatgagctgctcaaaatacttcttaccaacttccataacgacgtcagagaacatctgaatgaaacgtctgtaggaatcatatacgaaacgctcgaatgccggatccgggtttcctgcgatcattgctgctactacgtcatcatttaatccaagatttaagatggtgtccatcatacccggcatggaagctctcgcaccggaacgtaccgataccagtaacggattcttcagatcaccgaatttcttaccgttgatctcctccatcttcttaacgccttccatagcctgcgccatgatctcgtcgttgatcttacgtccatcctcgtagtactgcgtacaagcctctgttgtgattgtgaatccctgtggtacaggaagtccgatgcttgtcatctctgcaaggttggcacccttaccaccgagcagattacgcatggtcatgtcgccttcgctaaacatataaacccatttgttcgccattttgctaattcctcctaaactatacttactatgtaactatgtcagagccaacccctgccataattccgcaaacgaatgtacgtctcccaaaacgcacacatctataatatcatacttttgctaaatagcaacaattattttcgtctctttttgctgttttttgtcacaatttcacaattcaaaaccttgttccatgatgtggaacgcatagtgttttgaaaacagtaaaagagaccgggcactctgccggtctctctccccacacaaaaatgaactattcttctttcttaaattatgcgatcttctttcttcttacgatcacgcatgcacatgcacatactgcagcaagtgctgcaatgccaaacgcactgccctcacctgtcttcggggaggtcactgctgttgttccggcagaagtaccgtttccagtcttcattgcctcataatattccggtgagtaattattgttatcactggatgcaacagttgcagccggaatgcggataattgccatcggggagaaggaagtaaaggttgccgtcacaacgccatctcctgctgttgcagactctacataccagttaccgtcatgatgctgatgtaaaatgcatacattatctcctgcacttacagcaacagagaatttcagtgtaaccgggttggtctcagatgcgcctgcaacactatagtcgccagctcccagcacatctacattctgtccaaactgagctgttacagctgcctgtgccgctgctacctgggctgcggtcagctgttttacctgtacctcaattgcattgccgtttgcatctgttgccgttgcagctactgcgctgaaatttcttacataagttacgcttccatttgatgtggaagtggatgtgcttgtgctggtaccgctgcctgatgttgtaccacttgttgcattgttggttacgctcggtgcagcaaatgcagttgtgcttacagcgaatgtaagaaccattgctgctacgattgtgataattttcttcattggttttttcttcccttctttttattttgtgtggtctatatcaacgctttgcgttaatatcaagaatcttccccgatatagaacagatccaatatcatctcatagaactgttcctcatccacatgaaattcttcataataatctcccatcacctgttctcccggaaccacctgcaggctttcctctgaaaatccgcaggaaatccctgtcagcgcaagtgatagtatctgggttctggagaggttcgtcagcacagaatctgaaatgcccgcatacatccggaacggtgttctaagatcggctctcgtctcaccaatgaccttttccacaaatgctgtaagatactctttctgccgttgcagacgatactgcgcactgtacgcttcatcgcagtctctccacctcacaaaacgatacgcctgctcattattgagcgttactgtctctcccgcatggtagttctcaaaatcctgttccagaaaaaccgtcaccccgccagccattccattcagactctcaatggaattcagactaaatgtgacatatgcatcaatcgggagattataaaatagtctcgacactgcacgttccaccaattcacaactttttgtgcctccatccccaaatgcatactggagtgccagatgatcctgcagtaatccaagcggctcccccgtcatatagaacgtttccagatccgtcatcgtgtcacgcggaattgccacaatccgcaattttttctgctcccggtcgatcaccacaagaaaattggcatctgactgtgcgcctgaaccaatcacaccgccggcggacttcatatcattttctgtatccagtcccatacacagaatcgtgctgattttttcattccggcggtaagtttttccatggtacaagacggtgtcttctaacacgcatccatctgtctcatatcccgaatccgtcccacatacggcatgttttcccagactgtgcatggcagaaagccaaattcctcccgctgctgcgcatacgattatgacaagaagcagaacagccagcaggatacggcatgccaaggttcttttatgtctcactctcatagacctgtaccgcctccaccagcaaacgtttttcactttgatttttaatgcaggtcgacaacgtcagcaatttactatccgctgtcaccgcaatatcttcgcgtataacatccgtctcatcgccattttccttgagggaacttaaaaatgcctctctttcctccggttctgtaaaggatgcaaagctgcccatcaggtgtctgtcatcataagctattgcagcgaacacctgataaacccgttccctttccggtgtaatcacatagacatatggatgcttctccatatagctttcatcctgatattcatgcagtgatccaaacatagtgccgtttttcatatgatgtccatagactaccgtgttattatctgaaaaatctccggcattgcatggttcgacataaatagatcccggcagaccattctgcccttccgcagtgtgtgacagataataatcatcatagggattctctgcatcctgcttgcgcagcaccggatagctgactttcgtgtccggtatataaatccatgcacaaatatcttcatttgtctgccacagcgtatcaaaatccaccttaggaaccggtccataaatctgcgcttcgatctgctctgtaacttctgcctgaaccacaacgctctcctgactcatctgttcatactggcgctgaatcatcgcctgccggacagtgtgaaccacaaggtacaaaatgcacacaatggcaatgcctgccagtacaatctgtgcaatcctgtgtatctgttttttcttttgctgctctttttcttcgtttaacatttcaccgaactcctactgtgattctactatgattgtacccccccccccaatttttttgtcaatattattttctgccatatttcttgtcatctgcccaccatttttagacattatttcctaatttcaaaaaataccgcagacaggattcccccgccaggcgcggtcacttgcgacacgtatcctataacgaaaaaactgtcaccctaccgaacctggttcgataggatgacagttctctgtcataagaatattctttttaccacgcaaacttctgtgcaaagtaagcatccagttcctcgatcttgatgcgctcctgctccatcgtatcacggtcacgcacggtcaccgcaccgtcgttctcagactcaaaatcgtatgttacgcagaacggagtcccaatctcatcctgtcttctgtatctcttaccgatattgcctctgtcgtcgaattcacagttatatttcttggagagctgtgcgaaaatcttctctgcgccctcgtttaacttcttggaaagcggaagcactccgatcttaaccggagccagtgccggatggaaatgaagcacagttctcatatccggcttctcctcggtaccgatgttctcctcatcgtaagccgcgcataagaacgcaagcaccacgcggtctgcgccgagagacggctcgatgacgtacggcagataacgctcgttcttctcgtcgtcaaagtaggtaagatcctgaccggacgtctcctgatgtctgccaaggtcgtagtcggtacggtctgcgataccccagagttcgccccagccgaacgggaataagaactcgatatccgttgttcccttactgtaaaatgcaagttctgccggatcgtgatcgcgcagacgcatctcgtcttccttgatgccgagggagatcagccagtcacggcagaaacctctccagtactggaaccactccagatcggttcccggctcgcagaagaactccagctccatctgctcgaactcacgggtacggaacgtaaagttacccggtgtgatctcgttacggaaagactttccgacctgaccgattccaaacggaatcttcttgcgggatgttctctggacattcttgaagtttacaaaaataccctgtgctgtctccggtcttaaataaaccgtattcttcgcatcctcggtcacgccctggaatgtcttaaacatcaggttgaactgccggatgtctgtaaaattgtgcttgccgcagctcgggcacggaacctggttctcctcgatgaaattcttcatctcctcctgggtccatccgtccacggagctctgtaaggtgatgcccttctcctccgcgtagtcttcgataatcttatccgcccggaaacgctcatggcactctttgcagtccatcagcggatcagagaaaccgccgagatgtccggaagccacccatgtctgcggattcatcaggatcgcacaatccacaccgacattgtacggattctcctggataaacttctgccaccacgctctcttgacgttattcttcagctcaacgcccagattgccgtagtcccatgtatttgcaagtccgccgtaaatctccgatcccggatatacgaaacctcttgattttgccagcgccacgattttgtccattgatttttccattctaaattcctcgcctttcttaggttatattgtgatatgtttatttgtagacaatgaaagtatatacgtctgtctcgaacgaaccgtcaccggccgccgcctctgtctgctcggtatcatccgcattcaccggctccccggtcatctccatctgttcggttcccgaaagctgctcggtcccgacgctctcctgtccggtcacatccacggatgccgtcacgcttcccgtctcaagataatatccgtcacggatcgacacactgtcttttccggtcagcttcacattctgacaggagacatagcagatctcaccgtccaccttcacatccgtattggcacggatgatggcaactttcaaatcatcctcagagtaaatatcctgttttgtggcagctcccacaaccttgccttcctccacgcgggcgaactccccgtcgtagacgtatcctgccgccagggaagcaacgactttcccctgatagagttcaattccattaaatgcggtataatcctccggtgtcttgtacttcatcttaagcttcgccacaccgtcttccaccttaaggctctccaccttgactgcatttttaccatgctccgcggtgtaatcttccacctctgcatccacataggacttcagttccgtctcatcgtagtaggactgatcgagcgtctccacatccagcgacgctatcacgcctttctttcccacgtacacgacactttcctctccctccagcgaggtaccgcatccggagagaagtcccgcacacaacagtacactgcagaccgtgcacactaatctcttcatcacataatctccattctttctgaaaaagtatcggtgatattatactattttaaaaacatgatttcaaccttttccgcatcctcaagtatctttaacgacttgaaggcgtgtcccacgtacacgccaaaataactgcgcaaaagcctggtcagttcttccagtacctgcccgctcacggaaaacgtatataatttttcaatccgcgcagagatcacgtactgcatggtatagacggtggattcattcaattccaccgcatccggtgcctcgttgcggcattctgcgcagagaaccccgccgcgcttgacggaaaaccaggtcagatgctccctgctgccgcaggaaagacaggaaaacacattcggagcctcaccgtttaccgccagcgcttttagttcaaacaccgcgcgcaccagccggttgtcgtaggcactgctcgcaagggcgcgcagcgactggtacaaaagctttagcatctcgcgctcatcgttattttcctgacaataataatccgcaaattccagaaaataaaacccgtaatatgtagcatcaaaatccccggtcagctcacggaaataattctgaatcgttgccctcgcaagcgtgtaggcgcttcttccctcaaacagctcgaactctccgaagcaaaacggattggcagccgcgagaagctggctgttcggacgcctcgctccccgcgcaaatgctgtgatcttccctctttcttttgtcagcagtgtaatccgcttgtcatattcgccaatcggcattacctgtaagaccatcccggtcaccacaatattgtttcccatccggctgctcttcccccgccaaaatattactgctctcctgcacatccactgcattccggtagcgcaggtaatcagtcactcttcctgatactaaaaagtctctccaggcttcctccatcggcatatcctccgtttctttgacgcttcccgcctctaagattaggttctccgatggttccgccattataccagcaaaaaattggcagtatcagatatcgtctttattgtacccgaagttcttcatcatcagttcgctgtcgcgccagtccttgcgcaccttcacccacagttttaagttcacctgcgtatccaaaagccgctccatctcgtagcgggcattcgatccgatcttttttaacatcgaaccgccttttccgatgatgatgcccttgtgggaatcgcgctcacagacgatcgttgcatcgatgtcgatgatgttctgccctctccgctccttcatccggtcaatgtagaccgcgatgccgtgcgggatctcatcatccagagcatgaagcgccttctcacggataatctccgcgacaatggcgcgttccggctggtctgtaaccgtctcctcgtcatagaacatcggtccatacggcaggtacttgaaaatcacgtccacaaccgtatccagattctgctcccggagcgccgatgccggaacgatctctgcaaaatcaaacaccttgcggtaagcatcgatatactccaggatcttttcccgctccacggtatccaccttgttgataattaagatgaccggcgttttcgtcttctttagctgctttatgatatgctgctcgcctgccccgataaacgtggacggctccaccagccaaagaatgacatccacctccgaaagcgtgtgctccgccacattcaccatatactctccaagcttattcttcgcctgatgaatgcccggcgtatccaaaaacacaatctgtccgcgctccatatccgtatacacggtctggatgcggtttctggtcgtctgcggcttgttcgacgtgatagcaatcttctgaccgatcagatgattcatcagcgtcgattttcccacattcggtcttcctataatcgtcacaaatccggatttaaaattatctttcatcgttctcctcgtttctgtactgttttcccctccccgcatcaggtcaggctctcaagtgtctcaaacatctgtttttccgatgtcagcacatcttcattgccgatcacacacaggctgccgtctgagagcaccgacgcaatcaaaggcttcaatgcgcggatgtccgccggctgtgccccgataatctggctccgctcctttgaaagcgtctcgtagtccagctcctgcagataggctgtcatcgaacgcgcacccttcgcgctcgggttcatcggcgtgtccatatcgctgatcgttccgatgatatatcctgtcatctcgcgctcatcggcatcaaacttctcaaggtacgccgggatgccgtcataaatctcattcgttgcagagagattcggatcccggtaggacacaaaatacgtatctccgttcctcatatatccgttcatgcagccataagcgccgcccttgacgcggacattgatccacaggtaatcgtatcctaaaattacttttaagatgcggagcgccccgtgataggaaaagccgtgtgcggcataatttccagcacgcgccacatactgcacctgggatgcgtccataaatccctcgttcttttttgccagcggataggacggcatagagcgattcttacccggctgatccggcacatacaatacatttttcaatgcagccgacgcctgcgtcaccgccgggatctccgactcctcgcaggttgcactcaccagcatacgctccgctgtaaaaatggttttcacaagggaggacagcttctccatcagctgctgctttttctcctcaaaatgctcctcgtagtccgcgatcacgcgatagcaggcaatgcccgccgtcgcatcctggcagtaggcagccgtcgaaaaatacgacagcgctctcgtatatgccacggaatgtccggaagcgctcagtcccgcctgcagtctcgacttcaactgtgccaggatctcgtagatacgcttctcgtccgtaagatgcgaggtcagaagaatctccttcatcaggcgcattgcatccggcaatcttgacgcgagcaccttcgtgcgcacctcatagtaaagtccgatttcgccctgctttttgacgttcgggtagatgccgatgctgctgccgattcctccggtgtacatattgatctcattggcaagcgccgcgtaggaatgattgtccgtatccacatatcccagcactgcctttaagataccgagataaggcagatcttccggcagaatatcgcacacatcaaacagataggtcaggtaatcgataccattcgtgtccatctcatgcgcaacgatggaaacgccctccgtctcaatctcacggttaagaagcggcgccgcctcttttttcagatccgctctcgtaaggcgtggaatcttctctaagtcttccttcggcgacggctcttcctgatactgctttaagtgcttcgtgtctgcgatcagcttctttcgctcttccctggacaatcccgctttgtattcggccagcttcttctccagcgcggcatctctctttgcgcccagcccctgctccggcaccgtaatcactactgacgcatgcggattgtccagaagatatgtctttaccagttcctcataatatccggttccgatctgatccttcaaaaactgataggtgtccagcgcttccagatgcataaacggctgcatatcatcgaacagccagctgtccagacactggattccgtagagcagtcccttcggaaactgtccgaaatccgcctcccggaaacggaattccgagctgttgattccggctaacaatgcgttttgatcaattccgtctgccacctttgcctgcagcgtctcacggatcacctgcaaaaactgctccttctgctccggattcgcattttttgctatcacggaaaataccggctgcagcgtgctgttatcatagccgccgccgatgtccataccgattcccgcatcgatcagcgcctgcttaagcggcgctcccggcgcagaaagcagtgcgtagtccaaaacgtcaaacgcctggtataactttttgtccagaacggttccgaccaccacattgtaagacaggtagctgttgtccgtaagcggctcccccgatgccaccggataaggctttacgatctccaccggcgcggcgaacggcttctgcatccggattgcggaatccagctcgatctgctcgtattttccgaggtattcctcatccatccagcgcagcttttctgcaacgtccatatccccgtacagatagatataggaattgcacggatgataatactttctgtggaagttcagatactgctcataggtaagctccggaatatgctccgggtcgccgccggattcgtttgcgtaagaggtatccgggaacagtgaatttaaaatcaggcgctccaacacatcatccggggacgagaaagcgcccttcatctcgttgtacaccacaccgttgatcgttaccggcgcatcttcatcctccagctcgtaatgccagccttcctgctcaaagatctctctgtgcttgtagatgttcggatgaaataccgcatccatatagacactcatcaggttctgaaaatccgcattgttgcagctcgccaccggatagatggtcttctccgggtacgtgatcgcatttaaaaatgtgttgagcgatcccttgaccagttccacgaacggatccttgaccggatatttgtccgatccgcagagcactgtgtgctcaatgatgtgcggcacaccggtcgaatcctccggcggtgtgcggaagccgatgtaaaacaccttgttctcatcgtcgttggagatcacggtgattctcgccccgctctttttatggcgcagaatatatcccatcgaatgaatatcctttaactcctgctcaccaagcagctcatatgctgtcaattctgaaagcttcataaatccataattcctttcctgcccggtcatcctgtatgtccggtatttacactgtgttctattataacagcttttcccattctgcaaaagagtaaactatctatagattttgtctggaacactctgcgaacggtgccggcaaagtaccacatgaaagtttctgaaattgtccctgatttgctgggcacctgccagattgtccaaacgcaaaaaagaggctgcctgaatgcggcagcctcctcccatgtcttcacagatatattctactgataagaactccctatgcgatgcgtgtcacattcgctgcctgcggtccctttgcaccctcagtcacctcgaactcgaccttctcgccgtcctttaactccttgaatccatccatattcagtgcggaaaaatgtacgaatacatcgttgccctctgcatctgaaatgaagccatagcccttcttggcattaaaccactttacagtaccctgctgcataattctaaaaaccctcctcaatacagttctgacattacagactattcctgtctgtataaaacaacaaattgaaattagcacattttactttttttgtcaatctttttctatcgttattgtttaatttgcacatcaatctgctggtatgggatagaaattcccttcgcatccagcgcatacttgatattttccgtcatgcgccagcgcgccggccagtaatcctcggtcttaacccagaccctgagtccgatgtccaccgaagatgccgccaggttgtccacatataccacaggcttctcctccgggattctggcttcctccttctccgccaccgcatagatcacatctttggcagtgcggatatccgcttcataggcgatgcccaccacgagatccacacgacgtctgtccttgttggtcacgttggtaagactgctgttggaaagtgtaccgttcggtatcacaatcagcttgttgtccacggtaagaagtttggtataaaaaatggaaatctccgtgaccgtcccctcattattgtgggaatgttcaatgatgtaatccccgaccttgaacggctttaacagcaaaatcagcacgccgcccgcaaaattcgacaggcttccctgcaacgccagaccgaccgccacacccgccgatccaagcaccgccaccgctgatgtcgtcgcaattccaaacaatcccataatgataaaaatcagcactacatacagcgaatacttgatcaccggtatcatgaactgcttgacgccctcatcggttcccgcccggtccatcgagcgccgcaccagctttgtgatccacttgatgatcctgcctccgatcacatacacaagcagtgcgatcagaatctggaatgcgaagtttaacagatccggcaccagcccttccagccatgtacggataatccccggattctttgctacctcctcaattccctcctgtgcatggttcaatgcctccacggtctccgtggtcgacgggaatgcatctgtctgtgccgccagataccttccctgttccaaaagtgccgctatcccgttcactctctcgtcctccatccaactttataatccttcttaaatttcatgaataaacagaccgctccttagcttcggctcgaaccaggtcgatttcggcggcatcaaaagtcccgcatccgccactgcgaacagctccgcaatggacgtcggatacattgcaaacgccaccgcgcagtcctgctcacagcgccgcaccagttcgtccatgccccggattccaccgacgaaatcaatgcgtccgtccgtcttcggatctctgatgccgagcaccggttcaagaagcttattctgcagtatggaaacatccagatctgcaaccggatcttccggcgtgcggtcctcctgccggatatggcaggaaaaccagtgtccttccatatacatgcaaaaggttccccgctccttaggtctggtatcctctgccccggtaatctcctcaacgtcaaaccgcttctcaacttcacggtacaatcccttaaaagaatacccgttcagatcgcggatcacacggttgtaatccataatcatgagttcatcatccggaaacaataccgagagaaaatagttaaactcctcctccccggtataacccggatgttccttccggcgcttctgccctacttttaccgcggacgctgcccggtggtgtccgtctgcaatgtagatgctgtcaacgcccgcaaacgcttcgtgaattgcggcaatatccgcatcctcgcggatgacaaacacccggtgtctcacgccgtcctccgatgtgaaatcatattccggctctccctgcttcgtcttttccacgatacgccggatcccgtcattcgcgcggtacgccagaaagatcggtccggtctgtgcgttacagacatccacatggcggatgcggtcgacctccttctccgcgcgggtattctcgtgctttttgatgatgccgttctcataatcatcgatggacgcgcaggctgccactcccgtctgcactcttccgttcatggtgagttcgtagaggtaataacactttttatcctccgtcagaaacgtgccgtcctccacccattgccagagcgtgtcatgtgcacgctcatacaccttgtcatcatacatatccactgacagcgggaactgtgtctccgcgcggtcgatgctaaggaaagactgcggatgccgctccacttccttcgtagcttcctctctgttataaacatcataagggagggcagcaatctctgctgccttccctctctgtggtctgatgcttacaaatggtctgatttctgccattgttctcacacctcgttattttactttccgtacttttagtactccatccgtctgctccagctttgcgagcacatcctccggcacgttcgtatccacatcgatcagcgcatatgcatagtcgcccctggacttgttcgccatgccatcgatattgattccggcattgccgagaattgtcgtaaaatggcttaacataccactctcgttcttgtgcagaataccgattcttcctgccgtcatgcaagcgcccatgctgcagtccgggaaattgacggaatgtacgatattgccgttctcaaggtaatcgcggatctcgcgcactgccatgagcgcacagttgtcctcagactctgccgtggatgcacccagatgtggtgtcacgatgcagccctttgcgccgactgtcgtggtgttcgggaaatcggagacatattttttgatcttgcccgctgcaagtgcgtccaccatcgcctcctcatccacgagaagatctctcgcaaagttgagcacgatcgccgtcggcttcatcattgcaatcgcatccgcgccaatcatctttctggtggaatccaaaagcggcacatgaatcgtgatatagtcgcactcgcggtaaatgtcctccacgttgctgatgtgcttcacgctccgggaaaggctccacgctgcactgacggaaatatacggatcgtagccgtacacttccattcccatgtgggtcgccgcattggcaaccagaacaccgattgcaccaagtccgataacacctaacttcttgccggaaatctcggttcctgcaaaatttttcttctgcttttcagcagttttggcgatattctcgtcgttctgattcgccagacaccagtcgatgccgcccacgatatcacgggacgcgtagagcattcccgcaaacaccagctccttgacaccgtttgcattggcgcccggggtgttgaatacgacaattcccttctccgcgcatttatccagaggaatgttgttcacgccggcaccggctctcgccactgccgcaagtccctccgggagttccaggtcatgcattgcggcgcttctcacaagcactgcctccgcatcctttatgtcttccaccttctgataatcatccgaaaacagatccagaccgaccgctgcgatcggatttaagcaatgatacttatgcatttgcattctcctcctcgaactttttcataaacgcaaccagcttctccacgccctctttcggcattgcattgtagatggaagcgcgcataccgcccacggtgcggtggccttttaaattcacaaagcctgcggctgtcgcttcttttacaaacttcgcatccagctcttcgttgccggtcacaaacggcacattcatgagggagcggtcctccggaacaacggttccgtggaacagtttgctctgatccagaaaatcataaaggatcttcgccttttcctcattgcgctccttcatcacggaaagaccgcccatcttctttaaccacttgaataccttgccgcagatatagatgccgtagcacggcggtgtgttgtataaagaatccgcatcggcgtgtgtcttgtattttaacatggttggtgttcccggaagggtatcttccgtgatcagatcctcgcggatgatgacaatgacaacccccgccggtcctacgttcttctgcacgccgccgtagatcacaccgtattttgtcacatccaccggctcggacaaaaagcaggaggatacgtccgctaccagcgtgtgtcccttggtattcggaagcttcttgtattttgttccgtagatcgtattattctcgcagatgtacacataatccagatcttccgggatatccaggtcagaacaatccggaatataagaaaacgtcttatcctcggaggatgcaagctttactgcctcgccgtaaatctgtgcttcctgataagctttcttcgcccactggcctgtgacgatatagcctgccttgcggttcttcatcaggttcatcgggatcatggcgaactgctgggatgccccaccctgtaaaaacaggactttgtaattgtccggaatgttcatcagatctctcagatcctgctctgcctctttgatgatgttgtcatacaccttggagcggtggctcatctccatcacagacattccgcttcctctgtaatccagcatctcatctgctgcttcttttaagacctcttccggcagcactgccggacctgctgaaaaattgtacactctgctcattttctaattcctttcctttctcttttattacggcagttccctacgctgccgcctccatgccccctgtaacaaaacatatacgcatgttatgactgcgctgcggctaaatcctccccggtaaatgccgtactgatgtccgcacccggagcaaccatcggccataccttgtcatcgcagccgatcacacaatcgatcactaccggcgtctttgcagcaagcgctgcttttaacgcctcattaaatgtctcgcgggttgtggcgcggtaccctgtcgcccccatcgcctccgcaagcttcacatagtcgacgccgtcatctaaaaccgtcgctgaatagcgtttttcgtaaaacagatcctgccactgccgcaccatgccgagcacatgattgttcacaatcacttcgatcaacggcagcttctgccggactgcggtagcaatctcgttcatattcatgcggaaacatccgtcccccgcgatattgatcacctgttttcccggatttgcaacctgtgcaccgatcgcagcgcccagtccgtatcccatggtgccaagtccgccagatgataaaaacgtgcgcggatttttatatttataatactgtgcagcccacatctggtgctgtcctacttctgtcacaatgatggcgtcgccgtctgtctggcggtagatctcctccaccagataaggtccggtcagtcccggctcctggtatgtgagcggatattttactttatagtccagaatatgcgctatccacgcttcatgccccagctgcggcagttccgcgttgatccgctttaaaatttctttcaggtctccgatcacagccgcatcgacacggatatttttattgatctccgctgcatccacatcaaactgtaagatcttcgcctgctttgcaaacttcttggcattgccaagcacacggtcggaaaagcgcacgccgacggcgatcagcagatcgcactcgctcacgccgaggttggacgtcttggttccgtgcatgccgagcatccccgtgtagagatcgttcgtcccgtcaaaggctccctttcccatcagggaatcgcacaccggtgcgtccactttatgtacaaattcttttaattccgcgctcgccccagagatcacagcaccaccgcccacaaatatgtacggtttttccgccgcttttatcatcgcaagcgccttcgcaagatcctcttctcgtatcgtgtccgtcacacgcgcgatcggctctgccttgcagaattcatactccgtctttgccgccgtaatatccttcgggatatcgacgagcaccgggcccggacgccccttctgtgcgatccggaatgctctgcggatcgtgtccgcaagctttgtgacatcctttacgataaaattgtgctttgtgatcggcgtcgtgatgcctgcaatatcgatctcctgaaaactgtctttgccgagaagcggcacattgacgttgcatgtgatcgctacaatcggcacggaatccatgtatgccgtggcaattcccgtcacaagattcgtcgctcccggtccggacgttgcgaaacagacacctacttttccggtgcttctcgcataaccgtccgccgcgtgggaagctccctgctcatgcgaggttaaaatatgccgaatctcctgatgcttatataattcatcgtatacattcagtatggctccacccggatatccgaatacggtgtccacaccctgttctttcagacattcgatgacaatctgtgctcctgtcagctccatgtcgtataccttccttttctatcctactgttcttccgggagcgccagtattgctccgcggttgcccgaggtcacgagcgatgcgtaccgctttaagtatccggtcgtcaccttcggctctctcggctgccatttcgcctttctggcggaaagttcctcgtccggtacggcgagttccagctttaactccggaatattgatcctgataagatctccctcttccaccagtgcaatcggtcccccgaccgctgcttccggcgatacatggccgatcgacgcgccgcggcttgcaccggaaaaacgtccgtctgtaatcagcgccaccgaagatccaagacccattcccgcgatcgcggaagtcgggtttaacatctcgcgcattcccggtccgcccttcggtccttcatagcggattacaacgacatcgccggcaacaatcttaccgcccttgatcgctgcgatcgcatcctcctcacagtcgaagactctcgccggtccctcgtgcaccatcatctcatcgcagaccgccgagcgcttgaccacgctaccatccggcgcaagattgccttttaatacggcaagtccgccggtcttgctgtacgggtgatccaccggacggatcacttccggattcttattcactgcatccgcaatattctccccgacggtctttccggtcacggtcatgcactccgtgtgcagcagtccgatgtccgccagttctttcattaccgcatagacgccgcccgcctcgttgagatcttccatataagtcggtcctgccggtgccaggtggcacaggttcggtgtcttctcgctgatcggattggcaaatgcaatatcaaaatcaaatcccacctcatgggcgattgccggaagatggagcatgctgttcgtcgaacagccgagcgccatatccacggtcagcgcatttaagatggcttccttcgtcataatatcacgcgggcggatatttttgcggtacatttccatcaccgccatacccgcatgcttggcgagcttgatgcgctccgaatagactgccgggatcgtgccgtttccgcgaagtcccattcccagcgcctcggtgagacagttcatggagttcgccgtgtacattccggaacaggagccgcaggtcggacaaaccttctcctcgtattccttgacttcctcctccgtcatcgtgccggccgcataggaacctaccgcctcaaacatggaagagagactgcgctttttgccctgtacatgtccggcaagcatcggtccgcctgacgcgaacactgtgggtacattgatgcgcgctgccgccatcaaaagtcccgggacattcttatcgcagttcggaaccatgacaagcgcgtcaaactgatgtgcaagcgccatacattccgtggaatcggcaatcagatcacgcgttaccagcgaatacttcatgccgatgtgtcccatcgcaattccgtcgcagaccgcgatcgccgggaataccaccggcacgccgcctgcctccgcaacgccaagctttaccgcgttgacaatcttatccagattcatatgaccgggaacaatctcgttgtaggagctcacaatgccgaccatcggcttgttcatctcctcctcggtaaatcccaacgcgttaaacaaacttctgtgaggtgcctgctgcatccccttttttacattatcactcttcatctatcttaactccgtttctgtcattctatctgatccgctcgcagatcagatctcccatctgtgccgtgccgacctgggttaccttttcctgcggcttctcctgcggcatgatgtcaatggtacggtagccatcttgtaagacctgcttcaccgcctgttccactacatccgcctcccgatccagatcaaaactgtaccgcagcatcatggctgcacttaagatcgtcgcgatcggattggcgattccttttccggcaatatccggcgccgaaccgccgctcggctcgtagagtccgaactttgtatcgtttaaactggcgctcgagagcataccaatcgaaccggttaccatgctcgcctcatccgacaaaatatcgccgaacatgttctccgtcagaatcacgtcgaactgcttcgggtcttttaccagctgcatcgcacagttgtccacgagcatatgctcataggtcacttccgggtaatcctgcgccacctcctcgacgatctttctccagagtctcgaggaatccagcacgtttgccttatctacactcgtcacctttttgcgccgcttcatggcaatgtcaaaaccgcgcttagcgatccgtctgatctcgttctcattgtaggtcagcgtatccgtcgctgtcagcacaccgtccacttcctcggtcttgcgcgctccgaaatacagtccgccggtcagctcccgcataatcatcatgtcaaatccgtccccgatgatgtcgtcccgaagcgggcatgcggcttttaattcttcatataaatatgccggtcttaagttagcaaacaggttcagcgccttgcggagttttaaaagtcccgcctccggtctcttctccggcggcagctgataccacggcgaagtcgatgtgttgccgccgatcgatcccatcagcaccgcatcggaagccttcgcggaagcgatcgccgcatccgtgagcggctcacccgtcgcgtcaatggagcagcctcccatcagaatctcttcatagcggaacacatgtccgtaggtctttccaatctgatccagaactttctttgcctctgttacgatctccggtccgatcccgtcgccggaaatcacgcctaccttatattccatctctctaatccctcttttcttcctgccatgcaggaatccgtcttgtattgactttagtacattactaacagacagtatataaattctataataatgtatctcgggaaacaatgcaacctctgaatctatttttctttttcatgtattccataacctggtcttatttactgcttttttaacgcaacacttttcagttcaaaataggcgagcagattctggttgcgccagtcctctgcatcctctgtaatatcatccatacaaatcatatagggctgctctgtataagcatccacgagtgcatccgttcccttcgccgcctctaatgtatcgtgtctttcatacgcttcctgcgagtatctctgcgcagttcctgttttgatctgcaaatgtgcctgataagcagtcgagctctccccgcagccgatgagcaccccaagcagcagcacccccgtcacagccagatggccatgggagagctggtttatgacattctccgaagcagtgtccccagcaaggacacgcaccagccatccgcacaaatagaactctacgacaaacagtagcagcacatacgtaaaatacaccacatttgccagtcttccatcacctgctgctcccattccataatatggcggacaatacaatgcacagatataccccaccgccagaactaccaccaccagcggatatgaaaaacggaatcccttctctcggtacagccgctgcgccgcacgcaggataaacggaaggaacgctaccatgccgatgagtattttcagccccatccactggttgatcgcactaattccccatttcgttgcaagccagatggtttcaaaaaagcccggggtattttcaaatgccgactggcgtaccctcgtgccgggagagagcacattgatcagaaaacctccaactgtcactaccagtaccaccaaactgtctaccaaaaacggctttcgatgtaccactcctccataaatcacacagcctaccagaaaaaggattccgccaaacgccgtcacgtgattaccgcccgccagaagcagtccaagcagtcccgtgagaatcatctgcaggatgcgtctctttccctttcctcccaaccacaatgccgccgaaacaagcagcaataatacgcagaagaaaaacgtgtaattgaccgcaccattgtaccagtagattccctgcactgccgatggaatccactgcagcatcagagccgacatcataaaaccaaaggctgctgcttccagcctgcccattccaagctttctgtgcagcacctgccatgcaaaaatcagattcgcgccatacagagccgccagaatcagacacgcagcgatccgataccacgcttcgccaaaaataccgggctccagtgcctatatcaccgcggaggcgtaaagtccctgccaggtctggtaaaactcggctgaagttgcaaatgccgccctgcacacctcccacagggaatgtgtatctctccacgcatgataggtttctgatgcataccagtaatcgtctccagacggatggttgtacatggacaggtgcaaaagcggcaccaccgataaaaccgatattacaataatgctccaaagaatcattttttcatgctgctttttcatatatctttctccatttccatcgccgtatatttttttctcatcactttcataataattcccctatgatccaaaaaatctgccctgtattgctacaaggcagattctcttagatttccattcaatatcctgcttattcagctgcttcttccggcttctcaactgcggagatggccgccttctgcatcggaatacggcagttcttgttgcttccgaactcaacgattactgtatcatcagcaatatcgatcactgttccataaaaaccgcttgttgttaagatcgtatctcccactgcaagttctgcaagcatggagttcttcttctgctgttccttcttctgcggacgaaccatgaagaaatacataaacgcaaataaaataaccagccacaccaccatactgatccagccagcggatgacgcactctctgttgctaagattgaaaacatctgatatcctcctaaaatcataaacttgtccgaagtcatccgacttcattaaagagtattgtacacaaaacctcgctgtttggcaagccttttccctcttacttttccatttccttttcccggttgatctgtcccatgctgtatagcttttcttccttgtaggaggcaaagtttccggcatccagcgcatcccgaatctcttccatcatcgtgttgtagaagtacagattgtgcagaacacataagcgcatgccaagcatctcttttgccttgagcagatggcggatataggctctgctgtagcggcggcaggtcgggcagccgcagccctcttcgatcgggcgcatatccttctcgtacttctggttgaacaggttgatcttgccctggttcgtgtatacatggccatgtcggccgttgcgggacggataaacacagtcgaagaagtcaatgccgcgctccactccctccagaatattggccggcgttccgactcccatgagatagatcggcttgttcaccggaagataaggcacggtctcatccagcacatggtacatctcctcgtgtgtctcgccgaccgcaagtccgccgaccgcatagccgtccagatccagctcggaaatccgctttgcatggtcgatccggatgtccgtgtagatggctccctggttgatgccgaacagcatctggtgacggttcacggtatcctccagcccattgaggcgctgcatctcgttcttgcagcgctccagccaacgtgtcgtccgtgccacggaatcctccacatatttccgctcggcaagcgccggcgggcattcatcgaacgccatagcgatcgtggaaccgagattggactggatctgcatgctctcctccggtcccatgaaaatctttgccccgtcaatatgcgagtggaaatagacgccctcctccttgatcttgcgcaggcctgccagggagaacacctgaaatccgccggaatccgtaagaatcggacgattccacgacataaacttgtgcagtcctcccacttccctgatcagtttatcccctgtgcgcacatgcagatggtaggtgtttgacaactccacctgacacttgatctgttccagatcttccgtggagacagctcccttgatggcagccaccgtacccacattcataaataccggcgtctggatatctccgtgcaccgtatggaaaacgcctctcttcgcgcgtccttcctgttttaataattcatacatctgtttttcgtctcctttttattactcatgcaaagccggcgctgcttcacgcctccgtcttcttcccggtcagttcgcttaacacggtaaagtaatcttcaaatgtcttgcggcagcacgctgggttctcaatcacaatcccgtcagttctaagcccgatcagggaaaatgccatcgccacacggtgatcgtcgtatgtctccacgtttccgccgtgggggctgccgggatagatcgtgacagccgtctcttcctcctcacaccggatgccaagcgcggtcagattcgtctgtatcgcgtgaatccggtcgcattcctgtccgcggatatgtccgattccctctatgcgcaccggcgcgtcggcaaacggcgcgatcgccgccagagtcagtgcctgatcggagaaatcgttcatattgactgtgatgccccgcagcgcaccgtccgccggtcccgttacccggacgccctccggcgtatcatccgcattacatcccatgcgctccaacacttccagaaaacgcagatctccctgtgtgttgtccatatgcacatgacgcacaagcgcccgtccgccggtcaccgccgcagccgcgtaaaaatagcaggctgccgacatatccggttccaccgtataagtctccttccggtaggaagcctccgcgggcacctcgtagtctcttccgtcaaaagtgacactcactccgaatttctgcatcattttccgtgtgatacggatgtacgatccgtccgtcttctcgctggtgatgtggatcttcatcccctccggaaccatcggcgcaatcagcagcagcgcgcttaaaaactgcgtgctcttcgtaatgtcaagggagagcctccgcggcgtctcccctgccgtctcatctgcccgggcagatctgcaccctgcgatgcgcaccggaagatgcccttcctcctcgaggaaggtaatcttcgcccccgcaccggaaagcagctcgaacagctccgccatcggccgccgcttcatctgcgctgaacagcggatctcataacacccgtctgaaaatccgagcatcgccgcaaggaaacgcgccgctgtcccggcgcttccgacgtcaattaccgcttccctgctgggaatcctgccgccgcagcccgtcacggtcacgcactttttttcttcctctatctgcactgcaaagccgagcgacacaagacacgccagaaagtgtctggaatcatcggaaaacaggacgccttccacgcgcaccgttccggcggacagcgctgctaaaagaagcgcgcggttcgtcatgctctttgatcccggcacggttaccttccagtccaccggctctgttatctttttcacaaggtatttctctatcatgaaatattcttctcctcgcctgctggtacttctgctccgtcaaatcataacatatttctgttgcggcgcaaagtcaaatcttttataatcgagaaagatcattatgtaagcaggagggaatcacatggcagggtctacattgggaactctttttaaaatcacaacctggggggaatctcacggaaagggtgtcggcgtcgtcatcgacgggtgtccggcgggactttctctctgtgaagcggatatccagaagtttctcgaccggcgcaagcccggtcagtccagatatgcaacgccgcgcaaagaggacgacgccgtagagattctctctggcgtgtttgaaggaaagacgaccggcaccccgatctcgcttgtcgtcttcaaccgcaaccagcagtccaaagactacagcgagattgcctcctattaccgtcccggtcacgccgattacacgttcgaccagaaatacggcttccgcgactaccgcgggggcgggcgctcctccgggcgggaaaccatcgggcgtgtcgccgccggcgccgtcgccgtcaagattctaaacgagctcgacattacctttataacctacacaaaatccatcggcccgatcgccgtatcttccgggcactttgatttttccgaggtcacaaagaatccactctatatgccggacgccgaagcggccgagaacgctgaaaattatctggatgcctgcatgacggagttaaattcctccggcggcatcgtggagtgtatcataaaaggaatgcctgccggtatcggagatccggtctttgagaagctgaatgcaaaccttgccaaggcggtcatgtccatcggcgccgtcaaaggttttgagatcggggacggatttgacgtggcaaaagcgaccggcaagaacaacaacgacgcctttgtcctcggtgaggacggcagaattgccaaagcaaccaaccatgccggcggtatcttaggcggcatgagcgacggaagcgacatcatcctccgggctgccatcaagccgaccccttccatcgccgccacacagcgcaccgtcaatcagtccggtgaggagatctcggtcaacatcaagggacgccacgatccgatcatcgttccgcgcgccgttgtcgtggtggaatccatggcggccatcacgatcgtcgactcactcttttccaatatgagcgcacggatggatgcgttaaaagatttctactcctaaaagaaacaaaaaggtgatacttcttctccgccggctggcgcaatcgaagtatcacctttttctttttcatactttctagctcatccgaatatgctgatgtgtaaacagatgatcctgacagtattcgtaattgccctcgcacttggagcagaaacggaattccagcgtcggatcgtcaagttccgtcctgccgcagacagcacacttgtgcttcgcaccgcccgcatatccctgcggtcttcgcatgtctgccttaaacttctggcgtctgtgcacctcgtgcggcgtatagcgcttgaggtttctggtggagaagaagaaaataataaagttgaggagcgacataaaaatcgccattcttcccgcccatccggtctcaaaaaagcttaaagcaatcagaacgccgtacacagccgccatccacttcatcttaatcgggataatgaacatcagaagaacctgcatatccggatacatacatgcaaacgcaaggaagatggacatgttgatgtaacttgtgctgaaactcgttccgatgagaagcatctccgtcgtcacaccgccgttcaaaagatacatgataccgtacagcaaaaacgctccgatgacggtaaacagcatacctccgaaaatatagacgttaaaccggaaggttccccatgtgcgctccagtgtcgttccaagctgataatagaaaagcgccataatgagaagatacaccagattcgtgtctgtgggcataaacacccaggtaatcagacgccagatctgtccgtgcaggatgtgatacggactcaacatcaaaagtcctatgatcgacggattcacctggtagagcacaaacccgatcgtgtaagctccgatcagccacacgatcagattgggaatcgcccaattgccgaatttacgttctaatttatttaaccagttcatatactctgttcctgacctttccaaaaatgacattacgttgttcagtatatcggtcggggaaatctttgtcaatcagagggattcttctttacaaaaagtttatacttttccggcaaaatgcacattgtcttttgacatatcctgtcgtataatgtagagtgtttatcgccagattggcactatttataataagaagaaatcttttacatattttactctgctaaagtatttactttacgagaaacagccatggagggaattatggaaaacaatacacttcataaattgggaatcgacatcggttccacaaccgtcaaggtcgcaattttagaccaggaggatcatctgctcttctctgattatgagcgccattttgccaatatccaggagaccttatcctcccttctccagaaagcttacgatgcactcggcgactttgctgttgcaccgatgattaccggttccggcggtctgacactcgccaagcatctcggtgttccgtttgtccaggaagtgatcgccgtgtccactgccctgcagcattatgcaccgcagaccgatgttgccatcgagctcggtggtgaggatgccaagatcatctattttgagggcggcaatgtcgagcagcgtatgaacggcatctgtgccggcggtaccggttcttttatcgaccagatggcatccctcatccagacggatgcgacaggtctgaatgaatacgccaagaattacaaggccatctacccgatcgctgcgcgttgcggtgtctttgccaagaccgatatccagccgttaatcaacgagggtgctaccagagaggatctctctgcctccattttccaagcggtggtcaatcagacaatcagcgggcttgcctgcggtaagccgatccgcggccacgttgcctttctcggaggtccgcttcatttcctctccgagctcaaggctgcttttatccgcaccctgaatctggacgatgaacacgccatcacaccggagaattcgcatctgttcgcggcgatcggttccgcgttgaactacaagccgggcgagacaaccacgctcgtctctctccgcgaccggctctcgaacggcatcaagatggaatttgaggttgcccgtatggatcctctgtttgccagccaggaagaatacgacgctttccgcgcacgtcacgacgggcacaatgtcaagtccgcagatctctccacctacgagggcaactgctatctgggcatcgatgcaggttccaccacgaccaagattgccttagtcggcgaggacggttcccttttgtattctttctacagcaacaacaacggaagtccgcttgcgacggcaatccgttccatcaaggagatctatacgctccttccaccgaaggcaaagatcgttcactcctgctccaccggatacggtgaagcgctgttaaaagccgctttgatgctcgatgacggcgaggttgagacggtggcacatttctatgcagccgcgttcttcgacccggaagtcgactgtatcttagacatcggcggtcaggatatgaaatgtatcaagatcaagaatcagacggtggattccgtacagctcaatgaggcttgttcctccggctgcggttctttcatcgagacgtttgcaaaatccctcaactactctgtacaggattttgcaaaggaggctctttttgccaaaaatccgatcgatcttggaacccgctgcaccgtatttatgaattccaaagtaaagcaggcgcagaaagagggcgcatccgttgcagatatttctgcgggtcttgcgtactctgtcatcaagaatgctttatttaaggtaatcaagctttccgatgcaagccagctcgggaaaaatatcgtcgtacagggcggtacgttttacaacgatgccgtactgcgcagttttgagaaaattgcgggtgtcgaatgtgtccgtccggatattgccggcatcatgggtgctttcggtgccgcactgatcgccagagagcgtcacgaggcaggctaccagacctccatgctttccatcgaacagatcaatgcgctgaccttcgacacaaagctggcaagatgtcagggatgtaccaaccactgtctcctcacaatcaaccgcttttccggcaaccgccagtatatcaccggcaaccgctgtgagcgcggcctcggcaaggagaaaaataaagacaacattccaaacctctacgaatacaagaacaaacgcctgtttgactacaccccgctttccgccgaggaagcagcacgcggcacagtcggtattccgcgcgttttaaatatgtacgagaactacccgttctgggcaactttctttaagaagctcggtttttccgtggtactctccccgcagtcgacgcgcaagatctacgagcttggaattgattccatcccgagcgagtccgagtgctacccggcaaagctggcacacggtcatgtgacatggctgatccaccagaacgtcgattttattttctacccgtgtattccttatgagcgcaacgaattcccggattccaacaatcactacaactgtccgatcgttacctcctacgcggaaaatatcaaaaataacgtggacgagatcacttccggtcaggtgaagttcttaaatccgtttatgtctttcgccagcgaggagacgctttcctcccagctgattaagacctttggccagtcggagttcgggattccggaatccgagatccgcgacgcggttgccgaaggctggaaggagcttgccgtctgccggatggagatgcagaaaaaaggcgaggaagtcttacagtatttaaaggagaccggaagacgcggtatcgtcctcgcaggtcgtccgtaccatgtagaccctgagatcaaccacggtattccggagctaattacctcctacggcatcgccgtgctcacggaggattccatctcccacttacagccggtggagcgcccgctcatcgtcatggatcagtggatgtatcactccagactgtacgcagcggcgaactatgtcaagacaagagacgatctcgacctcatccagctgaattccttcggctgtggtctggatgctgtcacgacagacgctgtcaatgatattctgacaaagtccggcaagatctacacctgtttaaaaatcgatgaggtcaacaacctcggtgcggcgcgcatccgtatccgttccctgatctcggcgatccgtgtccgtgagaagaagcagacgaagcgcaccatcgttccggcgaattacaaccgcgtcgtcttcacggaggaaatgcgcaagaattacaccatcctctgcccacagatgtcaccgatccattttgagctgttggagccggcgttccagacggccgggtacaaccttgttgttccggatgtggacagccgcacctgcgtggatgtcggcttaaagtacgtcaacaatgacgcctgctacccgtccctgatcgtggttggccagctgatggcggccgtgatgtccggcggttatgatatgtcgcgcaccgcggtcttaatctcccagaccggcggcggctgccgcgccagcaattacatcggcttcatccggcgtgcactggaaaaagccggctatccggacgttccggtcatctcgatcaatctgagcggtctggagaagaacccgggctttaagctgacactgccactgatccagcacggactctacgcgttggagtttggcgatatcttcatgcgctgcgtctacgcaacgcgcccttacgaggcggttgccggatcaacggacgagttgcacgaaaaatggaaaaaagaggttatcgcctttattacccagaaaaagatgctctcccacggcaagttcaagaaaatgtgccgcgagatcatccgcgattttgacaaccttccgcgcaaagacatcaagaaaccgcgcgttggcgttgtcggcgagattcttgtcaagttccatccggctgcaaacaatcatctggtggagcttctcgaatccgagggcgcagaggcagtcgtaccggatctgaccgatttcctgctctactgcttctacaatacgggctttaaagcagacaatctcggcatgagccagaagtccaagaagatcggccgtctgggcatcaatttctttgagtggctgcgcagcgctgcaagagatgaattcacaaagagcaggcactttactgcacctgcgcacatcgatgatcttgccagatatgcaagagacattgtatccgagggcaaccagaccggcgagggctggttcttaaccggtgagatgttagagctgatccacaccggaacaccgaacatcgtctgcacgcagccgttcgcctgcctgccgaaccatgtggtcggcaagggtgtcatcaaggaactgcgtcaccgctatccgggttccaatatcgtggccatcgattacgatccgggtgccagcgaggtaaaccagctcaaccgtatcaagctgatgctctccaccgcgaacaaaaatctggcaaagcagaacgcaccggagcagaaggatcaggctgcaggctgacagatacagagaaaggggctgcgcatcaaatgtgcagccccttttcgtgataagtaatattatcagaagatcacaccgtgggatttcagatggagatacagagggaaatttggttcaaaaaatgtggcatttctaaccagccggatgtttgcatcttcgatgatccgtgtctttccaagtttggagcactccgcgggtcatgtccgcatcccggaagacaatttgtaggacttttgtgtgtgtcccttgcggcatcagacaacagatggcataaatgccatctttatgtcgaacaaaacataaccgcgcgaagccgatgtctgagtcggcatctgccttattttcaatagcagatgccggcgagtttcggttcgcgcggttttatattgtctgtgaaaaggtgccattagggacaccagaaagtccgcccattgtctccggtgtgtcggacatgcacccgtcggattgtccaaacgtggaagagacacggaatccgatgcaaacattcggccggaagaaatgctcacatttttctccaacgaattttcctctgcatttccacatgaaatctgtaggtgtgtttcttataatatttaatattacttatcataaaaaggacacaacacacttcatgcgcgccccttccgctgcattgcgtcagccctgcttaggacagccacaggcacgcaagctgcaccgccacaatgctcaaaataacactggcacacacataccctatccccagtccatagcttccgttctggaacagctggctggtctcgagtgcaaatgtggaaaatgttgtaaagccaccgcagacgccggtctttagcgtcagtaccagaagcggcggaagcgaatgcttttctcccagaaccgccagcacgccgatgacaaacgcaccgagtatattgatcagaagcgttttgaccgggaatccgttggacgcgcccaccggcaccagtccgatcagatagcgcagcatggcaccgacggctcctccaagtcccacacacagacattttatcatatgaatctccctctccattccgcagacgttttttcgcaggaggaatcaccgttcaaatttctcccgttccttccaatatttttaatccgaaatacgattcaaggtcacatcatccaccgttccccagcttttcacattacacttgaagcgcacgccgattgtgagtgtactgtccgtcaccttaatttctctgaccgtcggattctgccagtcggcataggttgtcatcataaacggatctgtccattccgtaccgtctgccactgcatacaattccatcgaagcgtccactgacatatctccgccctgtgcgtacgccgaaagctgataggttccaggcgcaagatccgtaaattcctgctcgatggaaaagtccatatcggaatctcccgaccagaaatggaacgcgatatctccggtgtaggcatcatccgccttgttctggaaatcggtcggattattctctccctcgtaggaaaccttccacatcgaagtgtcctcatcctcaaagctcggatttaagacgtaattcaccatctccacttcaacctgtgccgtcactgccgtaccgtccgcaagcgttcccgccacctcgtagcttcccgctttgcccgtatcgatcgcagcaagctgctctgcatcccaggtcacgtcctcctgtgtgttcgccgcgcggtcattgtataccacctcaaccgtatccggcagcgtcacctcaccgcccacatcgcaggttaccgcaacctccgtaataaaatcgacggcaagcggcgccgtcgcaccatatttcaaatatttgaatacatttaatgaggcaagcgggtgccccgtaaaatcaaacatcgcctgattgtcccaggaacagcctccgtaatacagaccggcatcctccggatcatagtccgccgaatagatgctcgcccagccgcttccgtatttttcccagagggctgtgttatccgcatcggcatctccgaccggaatccaggtgccttcccagtaaaagacgccgagcgctcccgcctcatccgccgctgcacagatgtcgcggatcatcgtcgcctggctctgcaccgtcgccacatatccgtccaccagatcctccgtgccggcaaaactatttgcaaagccgtcgccgtcctctgtcgtatagcagtaggatgtctctgcgatatagacatcttttccgtaggtgttctcaatattttctgcaactgcctgcatattttccatcgttccatcccagtaaggataataggacagaccgaacagatcgtaatccacgccggcattctgcagattggcagccctggtgtccacttcctcgtaatcctcaatattggtataatgaacggcaaccttgatatcttttccgtaatcctttgcaatctcacgcaccgcacggcttcccgatgcaatcagatccatgaccgtatcgacatcctcctcgcctgccatgccgttgttgatctcgttgccgacctgcaccattccgacatcgacacccgcgtctaaaagctcggcaaggctttccttcgtaaaatcatagagtgcctcgctcttttccgacgcactcataccctcccaggctttcggtgcatgctgtctcttcgggtccgcccagaaatccgagtaatggaaatccacgcacaccttcatgccgtacgccgtcgcccgttttccaagggtgaccgccgtcgcaacgtcattgttgccgccgccgtacccgtttccatccgcgtcatacggatcattccacacgcggaggcggatataatttacgccggactgtgccagcgtctcaaagacatcctgctcttttccttcataattgtaatacgtcacgccgctgttctccagtgaaagtaccgcggacgcatccattcccaggataaaatcatccggcagatcggcgatcggctccacatagatctccgactcctccggtccatccggcagcgcaaacgtcgtcaccttattatcttctgccgccgtcttaatcccctccgagacctctgtctgcgcgctctgctctgttcctccattgctcccgccgcagcctgcaagcgccgttacggcaagaccgccgctgaccataagtgccagccattttctgtaattcctgttcccacacgttatcatcacttcttctcctgcaaaaaatgtagctgcgcaaccggttacgcagctacattttatcacataaagacgtttatttcaacctccgttctgccagaaccaccgtttgtcccgacatgctctgtgtttctctgatcggcgcaaactgattttttctccagaaatgctctgcctgcgggttgcccttcacccagcagagccgcacggtgcggattccttcctcagccagatgacgacacagatcctccacaattctggtgccgatccccgcctgctgaacagaagcctccatcataaaaagtccgatatacgccatcgcccgctccgggtaatcggcaatgagatccatctgtgcaagcagtgtctctccccggaaaaatcccacgtaatacttatcatcggggagttttccgggcggaagcgccacaagatctgacaggatgctgtctcttgtcacatacgggggacaatattcataatacagattgttcttccgggagagttcataaatagctcccacatcctgctctgtcagtgcgcgcacctgatatttttccgaccagcggctgatgtccattctcttacagcgtccccggatctgtccgtcttttccgacccagacaagcattccctcatccagtcccatgttccacacctgctgctcctccatgcgcaccaggcaggtttctccttgttcgtttaccagcgtgatctcatcatacgccgcttccccgtcatcacgtccttcacagccaaaatccggctcgtcaatcctaagaatccgatattgcttctgtccgtccttcattgtcgtatctctttctctttgttttcattctcccggcatccggtcagcctttataatcgatgtgtccgccgaccaagcgttcctctttcgtctgcaccgtattcatccgctcattctgctggtaatcgctgatcttttttaacagctccccgatacttgacgccgtgatcgtcaccgtattttcccagtctgcctcagacgcctcatctgtcttattcacacgctctgttgcatgttcatctctttgattttttccgtccctgatccgcttctcctgcgcttctttctgcgcccgtctcgcctccgccttcttttcttccgccgccttctcgcgctttttctcaatccgctccttctgcgcgtcggaagacttctgcagcacggcaaaataggtggcggtgccgccatcattcacctgcatgccgtagccttttacttttgtaccggaagcctccagcgaacttttcatctgtgcaatgccgcttcccgcattcgcaatgatcgcctcgtactgtctgcggtaattttcatcctccgccatgcgctcaatcttgtcctcgtcgatgagaactaccatcttcgatgcattggcatagcttcccgcctgcgcccttgccttctccttctgatcctcgctgaccagaataaagtccatattggaatattttcttttcagttcttcataatactttgccgctttttcgctgagtttcggattgccgatcgttcttccagtcaccgttccggtttttcctgtcctgtctgtcttgtccgccttattggctttcccggtcttctctgacgatgcgtttccatccgtcttttcttttccttttgtgtctgccgccttacggttataggacatggcacttcccactgcatttgcataatccggtatcaaactcatacaaatctcccctttcgccatttccacctgccgaaatccgtttcggcaggtctgctctctttactttatatatcggtcagatatgtccatcttgccattgcaaatttaaaaaatcaaaggtaagataaaaggagtatcttttcgggaggtctcttttcatgaaccctacagtaagcattatcgtacctgtctacaatgcaaaaaattatctgcagcgctgcattgacagcattctgcatcaggaatataccgactacgaactgttcttagtcgacgacggaagtacagacggctccggtgacatctgcgatgcttacgccgccgcagatgcccgcattacagtcatccacaaagaaaataccggcgtatcggacagccgtaatctcgccatcagccaggctcgcggcacttacctgcagtttctcgacagtgatgactggatcacaccggatgcgacaaagctgttcgtgcgcgccgccacagagcatgactgcgatctggtgatcgccgatttctaccgcgtcgtcggagagcgcgtctcgcacaagggcgatattgaggataacggtgtcctcacacgcgaagagtttgctgcgcatatgatggagaatcccgctgatttttattatggcgttctctggaacaagctgtaccggcgtgatcttgtggaaaaatatcatctgcgcatggatgtctcggtgaactggtgtgaggactttttgtttaatctggaatatattttacatgccaacgtcttctacgccctgcaggcgccggtctactattatgtcaagacaaaaggttcccttgcaagtcagggattaagcatcacaaagaccgtcaagatgaaattcatggtctttgaatattacaatgaattttataagaatgtctacgacgaaaaagtatacgaaaaaaagcggctgtccgtctaccgcttttttctggatgccgccagtgacggcactgtgccgccgacgcttctgccgggtgcaaaaaagcttggcacagagcgcatcccggtctgtccttccgcgatctccggagagggtatcctatcggagttctaccggagccgcaagcttttggaccgctgtctggaggcgatcgccctgcgcaatgatctgacgcttggcgagctgtccctcctgctgtccttaagccagatgcatacattttgcagccgcacggaacttgccgattttgccggattatccaaaagctcgctcgcgcgcaccctgcaaaagctttccgccaaagattatatccgcgtcaacagcaccagaaaatacctgcacgtggatctgcttccggcagcgactgcgctcctcccggagctcgccaccgcacaaaacgattttgatatggcgcgctttgccggattgagcgaggaagagctcatctgctatgcgaaagtgacggaaaagatcaaggaaaataccatgcgggtgctaggcgtctagcgcccggccgtgttttttagataccgtaacaaaaaagacaagtacaaactgcttttttgtacctgccttcttcgattagaatgaaattttcccgttcccttacgctccgagaatctcctttaagtctgcctctggtgtcgtgatcggtgcaatatggtaatgctccaccagatatgctaacacattcggggagataaacgccggaagtgtcggtcccagcttgatgttctggatgcccagatgcagcagcgtcaaaaggatacagaccgccttctgctcataccaggacaataccatggataacggcagttcattgaccgagcagccaaacgcctcggcaagcgccaccgcaaccttgatcgcgctgtacgcatcattgcactgtcccatatccatcaggcgcggcagaccactgatctccccgagatccagatcgttaaagcggtattttccgcatgcaagcgttaagatcacactgtccttcggggtctgttttacaaattcggtatagtaattgcgtcccggtctggcaccgtcacagccgcccaccaggaagaaatgacggattgcgccgctctttaccgcatccaccacctgatccgcaacggagagcaccgtgccgtgtgcaaatccggtcatcacctctttaccgccgttgatgccggtgaactccgtatcttccttgtaaccgccgagctctaacgctttctcgatcaccggcgtaaagtccttgtccgcaccgatatgcaccatctgcggataagaaaccacctctgttgtgaatacacggtcacggtagctctccttcaccggcatcaaacagttcgttgtatacagaatcggcgccggaaccccgtcgaactccttctgctgattctgccatgccgttccaaagtttccctttaaatgcggatactgctttaacagcggatacgcatgtgccggaagcatctcaccgtgcgtatagacattgattcccttatccttcgtctgctccaaaagcagttttaaatcgtagagatcgtgaccggtgatgatgataaacggtcccttctccacggtaagcggcacctttgtcggcttcggattgccgaatgtctctgtgttggcgcggtctaaaagctccatacactttaaattcacctcgccgacttccagaaccaccggaagcaggtctcccatctccagatcaaagcccaggaacgaaagcgccttatagaaaaatgcattgaccgtctcatcctcatagccgagcaccgccgcatgataagcgtaggcagccatgccccggatgccaaataaaatcaaagacttcagggaacggatatcctcatccgcctcccagatctccttcatgtcgtaatccgaggtattgccgcacggcgatgcgcaggtggcacagttcggaaccacgcgttccttctccgcatgaacctttgcgatcatctcacgcagtgtctcatcattaaagttgacattcgtgatcgttgtgaataatccttctattaaaatatgtgtggtgtcctcggtgcgtggattgttgccgcacgcctttgcaagcccgatcaacgcgccggtcagttcatcctgcagcgctgccgtcgcactgctttttccacagacgcctgcattcccggtgcagccgctgcatcccgctgtctgctcacactgaaaacaaaacattttatgttccatattgatctctcctttgatttcctgattgattacctacgcattgtatgaaatctccggagatttttctgttgtttttccaacaaaacaattcttttcgcttttatttttcgcaaagctccgacaggggatgaaacgtgtatcccatttcctcccatttggtcagcagttcatccagaatctccccgttcgtcttcgaggtgctgtgcagcagcacaatcgcccccggatgaattcttcccagcagcttttcaaacgcctcctccttcgtcggctgtgcatcgacattccagtccacataggcaagactccagaaaaaagtgtgatagccgagctgttttgccatctcgagattcttcgtgctgtattttccctgcggcggtctgtaatagttcgccatcttctgcccggtcacctcggaaaaaagcgcggcgttgtcgtccatctctttctggaacgcggtaagatccgcgatcgacgacatatcgggatgatgataggtatggttccccaccgtatgtccctccgccaccatccgcttggcaatctccggcgcgctctccagaaaatgtcccaccacaaagaaagtggcaggcgcctggtgcttttttaatgcatcgagaatcggctctgtattcccgttctcgtatccgcagtcgaaggtcagatagagcaccttcccggacggatccccgacatagtgtgcatcgtactgcgccaactccgcagaggttgcattgccggtgggctgggttccctccgcgccaaagccgagcccccagttgcccgcctcgtacgcgaccgccgccgtctcttttgtctgtctgctccgcatcccggcgatctcccacccggttaaaaacatcgcggaaaataaaaacgcaaggcacaggccctttttacaattctgctgcataacaagatcctgtctgttctcttgttatctatgtatatcggaaaccgccctgtcccatgacagaatcagccgttattctgatagccgcacttcgggcagacgccgccgcccttatactggtagccgcagcggaagcagcagattgtatcgtgcttctcgctcgccagataggtaagctttctggactccggcttctcctgcagataatgaataaaatcatcgagttccccggcatagtccggcagctccttcgtgccaaccgcataagggatctttaatttggttccgttcttctggtgcacgtaaagtcccttattgagcagtcccgtagacgccgtgacagacgcaatcgaggcgaccgggattccgtaggaggtaaatgccgtgctgtagtaaagatgctccggcgttaaaatcatcccctcttttccagacgcatcgcgcgccacatccaccaccagaatcgggtactcaaacagacctctgccggccgcataggacgccatggcatattcgatcacatccgtctcctccggcgtcgcctgcccaagcagcactttcctcgccggataaaaatgatgtctcggattctccccgacaccgttctcctccagttcttttttcagctttcccaccagaagctcacactcgtccgccttgattttggagagccgcttttcgagcgtcttaagcgcatccgtcttaagctccgggagaaaatctccctccttgatcttctggtatgcctctatgccctcctcaaaattcatctgcatcggtgccggacagattgctgcgatggcatccgcatccagctccctgatccggtcgttgaccttctccagatagggtgccacaagccccggaagaaaatctccctccctaagccgctctgcaagatccacgtagtcctccctgctcacttttctcgcgcgccggatcatgttggaaagttcctgcttctccgctgcctctctccccgccacaatcttctgttcgtatggtgtcagatccactccgtcgtaatcgtgcagccggtcgacatagagccggtactgcttccggtcgagattcgccggcatctttgccaccatcgccgccacttcgcgctccgcctggctctgtttgagctgctgcagcttctcccgcagcggatgcttctgttcttccggaagatccgcagcttccacttcctccaatacccgtttggtcagcgtgtagttcttcccctcacaggcatccgctttttcctgaagttcccggacacgcccctcataaatccggtcctgtatcttctttatatatggcttcttctcgtcctccgtcagcttgcgctctccttccagctgccgctttaactcctgcagctgccggtcggaatagcggtccatgaccgccagacgcgcctcatagtgctcctgcacgcttttccgttcttccggtgtgacaatgacgccgtccacggtcattcctccctccggcgtctgcgttgccgcatggatgtcttttccgcctgtccgctccttagcggcgggtctgcccgctccatccgcgtccggacgcaggctgcttcctgcctccgccgctctgcgatctgctccatgcatttctgcctccgccgctctgtggtctgctctgcgcgtttccgtctctgcagccataccgcgtccgcggtctgccggtcgtccactccctacgctgtctgtctccttccgccccgctgactgcttcgccgtctctttcggtgtccgcgttccagactgcttatccggttcttccgctgcctgttcccgctgcggcaaagagcgtccctcgtcgtgccgctctctctcccggctgtgcacttttgcctcgtatttttccacggattcttccggataaaagccctcctccatccgcgcggacagctttttcacctcaagatccgacaattccggcagtgcgttgcagagatcctccagggattcctccccgtcctcctccgtatccggccgtcttccgtcggcatagacattcgtgtgatagttggacacccggtcggcatttctccccaaaagctccagataatcgtcatacgccgcgtcgtccgtcgcaaaatccagcgtgtaaatatcgccctccgagaacaatctgccgggacgcggcgtgtaaaaccgcctgcaggcattgcaggtcgcggctctcgccagcagcacgccgccctcctccgtctcgatcttaaattcctttccagccggatagaccgccatatgcagcttgccgcagcatgccgggcagagataccccacgaggtaaaaattattcccgatccggctctttctccgctcgctcaccgtgatgtccgcccgggcgaactccgcctgagcgcgtttccagacgaccttgtgccagagtccgccctcgttcgtttcctcatcctccggctgtgcctgctcctcttcctgcgccgtctggataacatcctcataggtgatccgcattccgctccggtagaaacgcagataggacggcgtgtactccggttcgacctgcatctccttcataatgtccgtaaacagcgtatttaactgttcaaaacttttgtctacgcggacgcccttgatcgtcccccattttccgaatgcatataaaatcaggttgatggcattctgcacccgcatgttcgtgccgacctcaccgatctcgtcctcttttaccggtatgtcgatgatgttcgtcgccacattgcgcgtgtcaaaatggaaaaacagggaacgcacctccccctgtaaaatcatgtaattgtcaatcactacaaatatgccgttccatttgaccggaactttcatcgcctcaatcaggcgttcaaatgtctggtgcaattccgtatttgctctcaacagtatcatagacgcaacctcacttctcatccatcgctttctaccaacagtatactcatatatgaggcgtttttcaaatctcgcatgcaaaaaatattttttttcaagaaaccatcccctcactttataaacttttaataattccgctgtttccctgtttttcagccttccgggaatgttgttagcactcatgtgaaaagagtgctgattttgtattgactttttggaatgacggatataaactcttatttaaaagggaatgacgatgttactgtcgtcttccgttctaccgtacatattttatttttagataaaggagtgttttattatggcaaacaaacatggaagtctttcaattgacagcgataacctgtttccgattatcaagaaatggctgtattccgaccacgacattttctatcgtgagttgatcagcaacggctgtgatgccattaccaaattaaaaaagttagacatgatgggcgagtacacgctcccagctgatttcaaggcaaagatcagcgtcaccgtagaccctgaggctaagaccctgacatttaccgataacggtcttggtatgacggcagacgaagtcgaggaatacatctgccagatcgcattttccggtgcgaccgatttcattcagaagtacaaggacaagtccacggacgatcagatcatcggacatttcggactgggcttctactccgctttcatggtagcggacgaggttgagatcgataccttatcttataaggaaggcgccacaccggtacactggacctgcgacggcggtaccgattacgaactgaccgacggcaccaagacaacgatcggtacacagatcacgcttcatctgaacgaggactgtctcgaatttgcaaacgagtaccgtgcacgcgaagtgatcgagaaatactgctctttcatgccgaccgagatctaccttagcaaggcaaatgccgagccggaatacgagaccatcgacgctgctgacaagcgcgataccgatacggtcgtggaggagattcacgaggaggcaaagaccgaggaaaaagagaacgagaacggtgagaaggagactgtcgagatctcccctgccaaggataagttaaagattttaaaacgcccggttccgctcaacgacactaacccgctgtggcttaagaacccgaacgactgcaccgacgaggaatacaaggcgttctaccgcaaggtattcttagattacaaggagccgctgttctggattcacttgaatatggattatccgttcaacttaaagggtatcctttacttcccgaagatcaatacagagtacgattccatcgagggaactatcaaattatacaacaaccaggtatttatcgccgacaatatcaaggaagtcattccggaatttctgatgctcttaaagggtgtgatcgattgtccggatcttccgctcaatgtctcccgctccgctctgcagaatgacggattcgtcaagaagattgaggaatacatcacgaagaaagtggctgacaagctgatcggcatgtgcaagacagacaaggaatcctacgagaaatactgggatgacatcagtccgttcatcaaatacggctgcttaaaagaccccaagttctgcgacaagatgaacgactatatcctctttaaaaatctggatgacaagtaccttacccttccggagcttctcgtaaaagaagaggagaaaaaggaagacaccgatgctgcttccgatgttgttgacaagaacggcaattccgtcacagaggatgctgatgcaaaggacgattccgaagaggaaaaggacgagcgcaaggtcatctactacgtgaccgacaaggtacagcagggacagtacatcaagctcttcaaggagcagggaatggacgctgtgatcttagaccacaacatcgatacctccttcatctcccagttagagcaacgcaacgagcattataaattcatgcgaatcgatgcggatgtcacagactccttaaaggatgcagacgatgccgctgatttaaaggaagagaccgacacgctgaccgacctgtttaaaaaggcacttggcaacgacaagctgaccgtcaaggtggagaagttaaagaatgagaatcttgcttccatcatcactctctccgaggaaggcagacgtatgcaggatatgatgaagatgtacgctatgggcggcatgggcggtatggacccgaatatgttcgccgcagaccagaccttaaccttaaacgcgaaccatgcactggtcaaatacattttcgagcacaaggattccgagaacgttccgatgttctgcgagcagctctatgacctggcaatgctgtccaaccaaccgttgtccgtcgatgccatgagcaagttcgtggagcgcagcaacaagatcatgatgcttcttgccaaataaatcaattcgtcttctcacagacagcaggatggggcgcgaaattcactctatgcgggtgaatttcgcgccccgtcctgctttttctatcggaaaatcccttctctttcacacaattttcacactgttaattgaggtgcgcagctatgaggatcttgcagcatctgtctcctatctgaaggagcatcatctccatccgtttgatgagatgccctgacacgcagggcatctcattttacgagacaacaagggcaaaatatccccagtcccagatcagccgttcaaaactgttctccaggtattcccagatatcctcgtcttcatatcccagcatgcgcgacagaattaccatacagctgcgcatggtctcataggaaagtgcgccttccctgtgccagcacagaaaagcggcatgccggatggctgcatactctaatgcaatccactgcagctttaccgtcacatactcgacgtcgtccggctcccccagacactccgaaaaaatctctgactgcagatagcaccgcatcagtgcctcatatggagaaaatgcctgcgcaaatgcatcgagatcttccttacggatcttcccgtaatcttccgcgatctgttccgcttcctctgccgccggtgttaaaaaagtacggtacagcccttccttccggtagttttccgccagatccagaaacagctcattgcgctccacaaatgccgcccggcaatccgccccggcatgctccaccgcatcggcaagttcttttctaaaaggcgcatccccgtatttggggacttccgccttccatgaagttcccgcgtcgcacagatcaagcgccatgtaaaacagcatgcaaagactctgtgccggccggtacgcacggtctgacatgattgtgaggaaacgttttctcaccccatacaccgcttcatatgcgccgtaggaggcactgtctgcctcatccgaaaaccggatgcactcccgcccccaaagcagatccacgaccgccggacagcagggcatcagagaatattccgtgatccccgccacctcatgtttctcgcgcggaaacaccgtacaggtctccgacaaaaccgcatccccgtaagttaaaaccagccggcagagctttctctcatccagaaacggacagcgcattttttcatcgagcgtaatgattcgtccatccccgtatttttttgtataatcagataaggtccgtcttttcggacggaccccttccggcgtttctgtttttttccatgcggcagccgtcttacggtccaccgcaatcttccattcctgacagcatgtcagactgcacgcatccgcgatgcattgaaactcatcataataatcgggcttcatttcgttccccctcatgtcattctgccggcctcttatcagagaatcttcgtcgtccacttcgagcagtcccagacctctcccacgatatcctggtaaaactccggctcatggcagattaacagaaccgttccgcggtactccttcagcgcacgctttaattcttccttcgcgtccacatccagatggttggtcggctcgtctaaaagcagaacgttggtctctcggttcatcagtttacacaaccgcaccttcgcctgctcgccgccgcttaagactctcacctggctctcgatatgctttgtggtcagaccgcatcttgcaagcgccgcacgcacctcatactgggaaaatgccgggaactcctcccagatctcctcaatgcaggtgcgcttgttctcccccttgatctcctgctcaaagtagccgaccatgaggttctcgccctgctcgacaccgccgccaagcgcgggaatcagacctagtagactctttaaaagtgttgtcttgccgattccgtttgcaccgatcagcgccaccttatgtccgcgttccagtgcgatcgaaagcggcttcgagagcggctcctcatagccgatcaccagatccttcgtctcaaaaatatatctgccgggcgtgcgtcccaccaggaaggaaaactctggcttcgggcgctccgccgcaagctcgatgacgtccatcttgtccagctttttctgccgcgacatcgccatgttgcgggtggatacgcgcgccttattgcgcgccacgaaatcttttaattcactgatctcctgctgctgtttgcggtatgccgcctcaagctgtgccttttttaccgcgtagacttcctcaaacttgtcgtagttgccgacatagcggtcgaggtgctggttctccatgtggtagatgatattgacaacatcgttcaaaaacggaatgtcgtgcgagatcaggataaacgcattctcgtactcctgcagatagcgtgtcagccacgcgatatgctccgcgtccagatagttcgtcggctcgtccagcagaagaatgtccggcttctccagaagaagctttgccagcagcaccttcatgcgctgcccgccgcttagatcggtcacatcatggtgcagcccgagttctaagagtccgagcgctctggcaacctcctccacctttgcgtcgatcgtataaaaatcatgcatcgtcagggtgtcctgtatcacgccgagttcttccatcatggcatccatctgcgactcgtccgcctcgccgagcgcatcacagatctgattcatcttctcttccaacgcaaacagccacgaaaatgccgactttaagacactctcaatcgtcatttccgcggtgagtgtcgagtgctggtcgaggtaaccgacccgcacatttttcgcccactccacttttccctcgtccggcatcagctttcccgtaacgatatttagaaacgtcgactttccctcgccgttcgctccgacaagaccgatatgctccccctttaacaggcggaaggacacatcgtccagtatcgcacggtcaccgaatccatgcgtcaaatgttctacgtttaaaatactcatccatcacctctatttcagcagaaaaaagtacaaaagcaccaccacgccgagcccaatgcggtaccagccaaacactttaaagtcatgctttctgatatatccgagcaggaacttgatgacgacaaccgacaccagaaacgcgctgaccataccggaaagcagaaccgcccactccgtcccggtcagatgaagtccgaagtccatcaattttagcaggcttgcaccgagcatcaccggaatcgccagaatgaacgtaaactcactcgcagccttccttgatacaccgattaagagcgcaccgataatcgttgcaccggagcgcgacgttcccggaaacgcagccgcgagcagctggaacaaaccgatcagaatcgccatttgaaacgtaatgtcccgcatctgctccacgggcgcctgctttgctgcattgtgattctccaccagaataaaggcaacaccgaacacaatcagtgccaccgccacacacaccggattgtaaaacagtctgtcgcaggtctcatccagccccagcacaacaaatacgattgccggcaggcaggacaccacgatcttgcaccagttgataatgaccggcatgcgcaccgtgacgggacctaacacccagtattctctctttgcaagagaaccgctcttctcattctgttctgcggccacgactgcttccgaggaactgcgcgcaaacggccagatcagattccagaacagcaccacaaccgccaaaatcgctcccagctggatcactaccagaaacatatcccaaaactctgcgctcacatccagtgtcagaaactcgtttaagagaatcatgtgtccggtgctgctgatcggcagccactccgtaattccctccacgataccaaatataattgcctttaaaatctctgccataaatactccattcttctcataactgctatgcatcagccgctgccatgccacactcagccggtaccatgcctgcttgctatgccacgctcagccggtaccatgcctgcttgctatgccacgctcgtgcggacaggctcgctcaacattttcttcgtcttcttcaacacatggaaatatgccgggaacaggaaacagtcagcaaaaatccatgcgaccgggcttgcaaagcacgctgccggatagccgaacatcggaacaaacacaaatccgaccagggtacgcgccgccatctcaaagacgcctgccagaattgcaaacttgctgtatcccataccctgaatcaaaaagcgtacaatattcacgaaagccaacggaatgtagaaggcactgttgcataccagaaacagccttacatttgcaatgacctccgcctgtgcactctccacgaaaaacatggcaagctgattgccgcaaagccacagcaccacaaacgccagaatcgaatatccgattcccagaattcccgccgcttttaatccgccgctcaagcggtctaacttcttcgctcccacgttctgtccgccgtaggttgccattgtagaaccgagcgcatcatacgggcagcagaagaacataccgatcttgcttcccgccgtcatggatgccacggcattcgatccgagcgtgttgactgcgctctgtaggatcacgctgccgatcgcggtgatcgaatactgtaatcccatcggcacacccatgccgcagagggttttcatgtagcccttattcactttccgctcttcctcatcggtgtgcaggatctcaaactttctcttgctgtagatgacgcacgcgataccggaaaatgcctgcgagatcacagttgcaagcgctgctccggcaactcccatcggaaatacaatgattaaaagcagatccagtccgatattcacaaatgcagccagcgccagaaaaatcagaggcgtcttgctgtcacccatcgaccttatcacgccggacaccagattgtacagataggttgccggaatccccgcaaaaataataacaatgtaggtgtaggcgtcatcaataatattctccggcgtctgcatcaactgtaagatcggccggcagaatgccaccgtaaacaccgtcatgaccgcagaaaagatcaccgccagatagactgcattcatcataaacgcacgcattgccttataatcgccggctccaaaccggtgcgccagaggaatggcaaaaccgttggacactcccatgcagaatccaataatcagaaagttcagcgaaccggtcgatcccactgccgcaagtgcatccactcccagaaatcttccaacaatcagggtatccaccagattataaaactgctgaaacaaaaatccaaacaacagcggcaccgaaaatcctaaaatgagcttcatcggtgaaccgcttgtcatatctttcgtcatagaatctacctcatttcatactgtatctcagatctcaccgcaatacttctcaaataccgcaaaaaagctgttcgtctgaatactgccatccgtggtaagctcaattccatcccacagatccgtgttcagcctcgaggataacgatgcgacaaattcattgtagacatcgtcaaatgcttctttttcacgtttttccacaatattggacttattcgcttccgtcagctcttcattatatttattcaggcacttgataaaatagtatccatttccggcagcgatcattccggagacggcattgtcgtccagctgaaatgccacctcctccacctcgtcgggcagatcatccctcgataccgtcacctgaatcgccgacaattcgttataattgttggcgacggaggcaaaatcatccccctgcgccagcttctgctccacctcgtgcgcccggtcttcgtccgtgacataaatctgcatgatttccatcacgcgcgcctcatcgtcgctgacctcctcgttgacaccgttcgtcagtgaatgatacagcttctgcgccagcgcatagtgcgtataatactccgcaatatccgcctcggcgacgtccatataggcggtctcatcctccgagagggatgcataatattcctttgccgcttccgccaccttcgcagtctcatcctccgagagcgtcacttcctgcgactgtgccagcagatccatcgtgtatacacgggtgagctcctccagcgtgatgtccttcacatagtcaagcagggatgcgtctccaaagtcatgctgccagaggtcaatcgtatatgctgttccatagatattctgataatttgccagatatacctttgcctcctttaagctgcatgcagacttgtccagtgtaaacacctgcctgctgcttagcgttcccgagaccacaatatctttattgccaatctggcatcccgtaagagccattgacagcgcgcatacgcacgctgtcattcccatcgcccatctttttctcatcgtgaaacaccctttatctcaacatctacatgatatttttcaagatacttctcgccacagaaattccgttcgcggatgcctgctgcagtcctctcgtcacggacgcgccgtctccgatcgcacggagtcccttgacactcgtctcgaagtcagagtttaccactaccttattggagtagaacttgacctccacaccgtagagcagtgtctcatcacttgcaatacccggcgttaccttgtcgagagccatcagcatctcctcgatatccaccatgatccggtgcgggaatactaaggagagatctcctggtaccgcatcctttaaggtcgggatgaggttgttacggcacaggcgctcctccgtcgttcttctgccacgcttaaagtctccgaatgtctgcaccagaatcctgccgtcacagagcatattggagagctgtgcgatctgcttgccgtattcgatcggcgtcttaaaaggctttgtgaagttcttcgataccagaatggcaaagttggtattgttggtctttaaatccttggacttgtaggcgtggccgttgactaccgccagtccgttgtcgtagtattcggttgcaacctcgccggacgggttggtacagaaggtacgcaccttatcatcgaacgtcggcgtatggtacactaacttcgcctcgtagaggttctcattcaagaactccatcacctcatcgcgcacctcgacgcgcacaccgatgtccacagtgccgacctttgtctcaatatcatgctgattgcagatatgggagaaccagtctgcaccctcacgtcccacagcggagatgacctctgctgccgtgtatgtctcatccttgtcggtaatgatacccttgacctggttgtcctcgatgatgatgtccttgaccatggtgccaaactccatctcgaccccttcctctaacaggtgctcctgcagtctggaatagatcttgtagccttcctccgtgccgagatgacggatcgggcattcgatcagctttaggttcgccatgatcgcttttctacggatctcgcggatttccttctctttatccacaccgtacaccttggaatccgcaccgaatttcagataaatatcatccgattcctttaacagctccacggtcttatcgtagcctaaaatctccggcaggttgccgccgacatccggcgataaggacagcttgccatcggagaaagctcccgcaccggcgaatccggtcgtgatggaacacggcttgcatcccacgcataccttggtcttacgcttcggacattcacggttctcaatccgtcttcctttttcaatcattaacactttcagatcctttttcgcatgaatcagctcatacgcacaaaaaattccggaaggaccggctcctataatgatcacatcataattcttcattacattccctcgttctttctatatattctaccattctgttatgtatcttcctacgttctccaaagcagacggcttaagcttccacgatcaggtatcttccgtccggcagtgcgaacacttctgcctgctccgccagatcctcgctgctcattccggcgatatccgcaccctcttccttaaagtacgcccgcacttccttcagattctcacagaccgttgcgaaacagtccgaaagaaattcctccgcctcttccctgctttctgccacaggttcccgaaacagcttctcctgctgcgccaaaaatgtatccaggcacatttcatcgtacatatcttttcctccgccaacgttttattttaccataaatagatatcaattccaagcttctttaattcccggtaaatggctgctaccggaagccctacaacattattatagtcgccatcgattttgtcaacaaaaatcgcacatttcccctgaattccgtatgcgcccgccttgtccatcggctcgccggtggcgacatagcgccggatctcctcctcgctcatcgcgcgcatcgtgacatcggttttctcatgaaacatcacctgaccggcctttccggacgcatccaaaagcacgatcgacactccggtgtatacctggtgtgtgccgccggagagaagcttaagcatgcggcaggcatcacgctcgtctttgggcttccctaagatctgtcccccgcaggagacaatcgtgtcggcgccgatcaccataagatccgagggtgtcaccagttcctgatgcgtctcctcgtaggttcttaccatggatgccacctcgatggccttctgcgacgccagttcctccacgacttcgtgcggtacgctcttcgtgatccgctcctcacctttggccgggcagatttcaaacgaaatcccgatctgctctaacaattcctttctccgcggtgaggcggatgccagtatgatctgtcccatctctttttcttcctttctgatgttcttatctctgaaatctatcgtttcttatgttccatttacgttacaccggtatcactgcgcccagccggaacgagtagagaagccgctccttcacgcgaagcgtcctctcacttccgtggttatagatccgctccagcgcctcgccgtagagctttaactgcgaagcataacggtccgccagttccttgccggttttcacacggtccgtcttatagtccagcaccacaatgccgtcctcctcaatccagaacacatcgatgattccctggatcagcgtcagctctttgtcatccgcacatttctctccgtctccgaatccgaatgccgcgagctcctcgcccgtaaatcccatcacaaacggtttctcccggtacagcgttccggcagtctccgcacgcttcatccgctctcccgccgccgatgtgagaaacgtctcgatgagagccggttttaccaggcgcttcatctcctccgtgatctgtcctccggcaagcatcgcctcaatctgttccgtgactcctgccgccgccgaaaactggtagcactccatcaccctgtgaaccgcagttccgcgcagtgcaccctggttctgtccgccggtttcttcctgctccatttttttttggacaaacggcggaacataggattttccctccgtctctaaaaacgccgggacaacatccgtctcctcctccagaagcttttcccgcatcgcccgatgctttaattccgacacggaatatttgtttttgcgctccagatcgcgctcgtacggataggtgaatgaaaacttcccgtcaaattccgccacgtctgccgcatccgccgctgcaatgcgtgacagacactgttccagattctccgtctcctccttcatgtgacggctctctgcgtcgagcagttcctccgccggcacaacgcgcacctgatagcgtccgtgataggaaaacaccgccggaagcagccagtcgaaatagcctgccgcgctctcccggagcagatacggcagaggaacatgctccgtttccgggaaaagttcctcctgtgccgcttcccttagcgccgccagatcattttctgcatcttttctgcaccccgttaagatcagcttctccttcgcgcgtgtgaacgccacatagagcacgcggagctcctcgcccagattctccagttcgatctgctttgcgatggcgcgctttaatatggtcggcgtcttgatcctgcgctcgccgtcgatccagtcaattccgattcccagttccgggtgcagcaccatgcggcttctggtatcctgcttgttaaaatttcttcccagaccgcacacaaagaccaccgggaattccagtcccttgctcttgtggatactcataatgcgcacgacgtcctcattctccccgaccatgtccgcctcgccaaaatcaacatcgtatttctggagttcatcgatgtagcgcacaaaatgaaacaatcccttgtagctcgtattctcataggcgatcgccttctccaccagcatgcgcagattcgctctgcgtctggctcctgccggcatcgccgccgcataatttccgtagccgctttccttcaacacgatctcgatcagctcgtgaatcggggtgtccggcacaagcgcccgcagcctctcatacagcttccagaactcccacagttttttctcataaccttccgccaaaggttcttcactctgcgcaagttccctgcagcgtgcgagcacacactcacagaaaggcacgctgcggtcgtgcgccctaagccgtcccagctcctcgtccgtaagcccggcgatcggagacttaagcactgccgcaagcggaatatcctgtctcggattgtcaagaatccgaagcatcgcaagcaccgtctgcacctccaccgccgagaaatagccggttgctgacaccgtatgcgccggtattcccgcctcgttcaacacggcggcaaacgaatcggcatacccgcttaggctgcggagcagaatcacaatatcgctgtaacgcacggtgcgcagttcccccgtcgccttgtccgtcaccttctgctctgtcatcagcttccggatgcgctctgccacaagcttcgcctcatacagcttccggtcttcgtacccgctgccctctaagagttcttcggcactgtccgccacaagaatctccggtgcaaacatccctgcctcatccggcgcacaataatctgcgcccgcgtagagcgccgcatcctcatcgtatgccacattgccgagatcgcgcgccatgatccggtaacacacatcgtttgtcagatcaagcacctctgaccggctccggaaattcctgtgcagatcgatacgctgcgtactgctttcctccagcgtgtaggtatcgtatttttccataaaaagctccggtctcgccagacggaagcggtagatactctgcttgacgtcccccaccatgaacaggttgtacgctccgcactcctctctcgagatcgccctaagaagcgtctcctgcacatgattgctgtcctgatactcgtcgatcatgatctcctcgtacatgtcgcggaactcctccgccgcagcgcgcgcctgctttgtctttgcatccacgagaatctccagtgcgaaatgctccagatcgtgaaaatccaccagattcttgcggcgcttttccgctgcaaacgcctcggagaatgcgatggcaagacgcaccagttccttcgccatcggctctgcccggcgcacctgcccgcacatgacttccggcgatgcaaagaaatactgcttgttgatcttttttaccgtatccttcacctggtcgcggagttccttcacacgcgaaagcttccctgcatctcccgaaaagccgcggctcgacggcagcctgtcataagtgacggcggtaagcttttcgtacagttccagaaaattttcacacgccgccagtccctcgaactttgcgagatccgacgagatcaccttctcatagatattcggtccgtcttcctcccgcgtaagcacatgcgcgatgcgaagcttttttaccagatccgccagcaccgaccgcagatgcagcacgagcggctgcatccatggcgcttctgccatctcctgcacatccgatatctcatagccacagatgccggaagtaagccactccatcggccacgggtagctcatggagaactcatagagcgagaggatcatctccgccaccttcgcatcactcttccccgacacatacccttttgcaaatgccgcaaactccggtgtcatctgttcgtaattgctctccagcacgccgcgcagcacgtcctcttttaacagctttaactctccctcgtccccgatcctaaaatccggctccaggtcaatctcgtggaaatgattgcggatcacatacagacaaaaactgtcgatagtcgtgatctgcgcattgtggattaacgtcagctggcgttgcagatgctccgaatccggatgctcctccagcgctttctcgatcgccgccccgatgcgctcccgcatttccgccgcagccgcattcgtaaacgtcaccaccaaaagccggtcgatgtccaccggatgttctccctccgtgatcatcttgataatgcgctcgactaaaaccgccgttttacccgaaccggcagctgccgataccagaatgttgcgctttcttaaatcgattacctgttgttgttctctggtccatgaaacacccatctactgtctcttctcctcgcttcgcgtctctctcattttcgcaagaatcgcctcggcaccgtccggcttttctaacttccggtaagaaaagcccggtatccgcgcgtcaaatccgcacaccatgtgatacggacaataatcgcagccgcttctcccgtcgagttcatacggtgccgccgccacatctccgcctaggattcttctgcccgccttcgtcacggtctccttcacgtagtccgacattgtctcaaattcttccgtactcgccgtcttggacgtcgcttttaaggaaccgtccgctttaagcgccacaggaatgactgcggagcttccggaaagttccgtatccatcgccccgtatatctcgggatcgtcgttgactaacccgttcggctttaattcctccagcacggcctgccggatctcctcctccgactctgtgccgctgccgtcaaccatgggatcctcaatgtgatagtaaaacattcccgcaggcaccgcctgttttcccggatgcttttttgcctccagttcgagcgccgcattcatataaaccaccagctgcagctgcagcccgtgatacagattcagcagggaaaatgtggtgttgcccgatttgtaatcaatgatctttacatacaccttatcgtccgtctcacaggtatccacacggtcaatcctgccccgcagacgcattttttcctcctctgtcagctgaaagcggattgcctccagatgatcggcctgcgaaaacgacacctcaaaatcactcggcgtaaaacgccccttctgcacctggatcgtgagcgcccacaccgtgcgccggatcgtgtctttcatgcacgacagcagatagcggttcttcgcctcgtcgaatgcgcccacattcgcacagcccgcaatcgcgtcattcatgctctcctcaatccacgcctcacgcgtctgttcgggcagatcgtaccaggtatacgaagacctgcggatgcgctccgcaaaatgccacagcgcgtcatgatagatatttcccatatccacgccggcaaactcctgcagttcccgctgcgacagtcccagtccgtaggtcatgtaatgcgcaaacgcacactccgcaaactgctccagccttgtgacactgttctccagttccgtgccgtataaggcgcgcgcaacctcttttccgatcggctctccgctgtaacggtaaaaagatgccgcaagcaggcgcagcgccttcgcatgataagtctcatccgagagataccactttgcaagcgccttccaggtatgtgacttttgttctgtccagagtccctccaacagataatcgatcccgctctccggcgttaaaatcgcggacgcctccgtctcctcctccggctcacggatctttagttccgggaacatattgcagagcgttccgatcagataagaccggcgcagcgcctttccctccggactgaccctcgagtaggtgacatacaatccgtccgacggcttggttaagttcagatacaggtaaaacttctggataaaaactttttcccgcgcccccggcgctaacatcagatgatgctccgccatcttctcgcgctcgaactgtgagatgatgcttccggtgctgccggctttcggcacgataccgtcattgacccccacaaagaacagaatccggatatgatttaatctggtgcgttcaatgtctccgaccgtcacgcggtcatttcccggcggaatcataccgacctttgccgcagaaaatcctgcgtccagaatatctccgtactcccggatcgacatctgctcctccccgagcaacgatgtaaccttgtcaaaaagatccatcacgatcttataaatctgaccatactcctgcgctctggtctggttcctgcgcacgccgttgtactccgtctcctccgcctgttctaagaggaactgcttctccttaagctgcgcttcaatatccagcgccgagataaactcatacagtccgtaggtctgctccgcaaccgtgtgttttttcccggaaaaaagtccacacagcggctcaaatgccagaacgatccgctcccgcacccggttcaaaagagccatctcctcctgcgccgcctccggatggcaggcatcccgcttcgtcacagacgtccatttctcgctccagcgctttctgccgcggattccctttgcaagcacataattctccaggcggtcaatcacatcctctgcatccgcaccggctccggctccagcgccgtcctcatcattcactccggctccggctccagcgccgtcctcgtctgccgtctgctccgtcttattctccgtcagaagccgtcccgccagtccgctccgaaggaagcggaacacactctgataggagaaatcaaactccacgacctcaagcgccgcgcggataaactcgatgaacgggtgaaacagaatgtttctcgtctggtcgataaaaaacgggatcccgtactgtgcaaacgtctccggaacgtagttggcatactgtggcacgtctccggtcaccaccgcaaaatcccggtaacggtagccctttgtccgtaccagacgcacaatctcccttgcgacaaaagaaagctcctggcgcggatcctttaagctggtgatgctgatgtcattaaccggcttccgccacttccggtacatcggacggaacagattctgttccatgaaaaacagctccggtgcattttcatagcgcctgtgctctcccggctccataatcaccggagagagtacctcgcatcccgcatccgccgcaatcttaagcagtgtctgtacggtctccttgctcatggaaaaaagctcgtgcacgcctctgctgtggtaaaaatcctcccggatatccatggagagcgacacgatgacgcggtcggcaagcggcagcatcaccctaagcagccggttctggatcggggtgaatcccgtaaattcgtcaaagacaatcacactgtccctgatgagctcggattcctccgccacctcacacaagagcgtcagaatctcctccgccgtgatgtatttcccgtcaatatactcccggaatccctcatacatcgtaagaatatcctgcatcttacagcgcagggtatccccgacatcctgcgcgcctagaaaagcgccaagatcctccggcgtgatattgtactgcgccatctccgagatcagggacttgatctcgccgatgtatcccattttgttgagattgccaccgagcaccgagagttcctttttcttaagctccgccaccttgcgcagcaccagattcttgcccgtctcctctaaaatgaccagatcctgcattccgagatcgtcaaacacacggtacgccagacgcacaaaactgagcacatccacgttcatgatggcatgattgggctgccgccacacaagttcgcgctgcgtctgcatcgtaaattgttccggaacaagcaaaaggaaattcttctccggttccctttccgcttcctccaatatcgactgatataaataatcggactttccgcttccggaattgccgaacacaaactgtaatgacataaaaaacgtgccccctgttcacagcaatattttaacacaggtgcacgcttcttccaaataatattctctctattttctcttaattatttctgatgtcagccgatatatatagtagagaaggaactcattaacccctatcagttgtgatttatttgtcaaggaggatgattgtcgcaatctactatgatagtgttttcgtgttacccgttcaccccgtaaaccggatcgaccggcttgcaccagagagcagaaagcagcaacgttccaaacagcagccttcttcttcgttcgccacactgctgcatcaggcaatgacggtgacagaggaggatgatgttcattcgttcgatgccactgcctagagaaaggttctatgaatcagacaaaagaatttcataagaaggcccccggttgacaatccaaggtttcgtacctttccattgcgcccgggggttttcttatgcctgcaggcaggcttctcttttatttttcatacaggaattcttccggcagggtcacatgaaaatcctctgccagatgtctgaagtcgtccggctgtatcgtctggagcttatccggacgcatggagagcgtcttcaccagaatctccgcggatttttctgcggtgtgcatcagaccgaacgttaagtcaaagtcctcgccggcagcaaacatgccgtgatgcgcccagatcgcaagatcatattttttcatcagctcgctggtcgcaaccgcaatctccctgccgcccggaaccatccacggcaccacgccgacacccgccgggaataccaccggacattccgttgccatctcccagagttctctcgtgaatacgcggtcctccagtggaagcacgaacgtcagcgcaatgatattggtggtatgcgcgtgatagaccacgcggtacttcggattctgcagtttctttacctccaggttcatcagatggctcggcagctccgaggtcggtcttccgccgtttaccagtccccacacgatccggtagttctcgcccttttcatccagctcaatcatgcagatcgaatcttccggctttaagatgacgttgcggaaatattttccgcttccggtcacaaggaaatactctcctgccagattgggcaccgtggtgccgatcggctgccactccttttcctgaaagttctcccgcaccgcttccacttcctccggtttcacgcggtaagataagtttccgccgtttctctcatgccagccctgctcccatccgtcgtttgccatgcggataaatccctgtacaaattctgcatccaaaaatttcatgattctcttcctctcttctctctgattcagcttctatctgcttatcctcttttggtcagtacctcacgctcgtaacgctcgatctcgtcgtagaaatgaaggtcgtcgcacacgccttccctgcggcagtattcctcccagatctcgccgatcggaagcatttttaccgcctcatgcataaccatgagttttcccagctgattcgtatcctgcagctcctttaacatttcattcggcgtgcacagtgccgttaacagggctttctgccagctccgaaagcctgttgcaagcgccaggacacggttgatgctcgcatcaaagtaatccagcgccatgtatacacggtcaagcgcatcgtttcttacgatctcttttgccatctctttcgtctcgtcatctaagagcagcacatgatccgaatcccatcgcacgcctctggtaatgtgaagcgcaaactccgggtaaaaacagagcatggcaggaatcttgtccgaaacatactccgtcggatgataatgtccgttgtccatgagcggcatacagccttcatgctgtgcggcgaagctcaatgtaaattctgccgaacccacggtgtaagactccacaccgataccgaataccttggattccacgcacggcttgacgagatttctgtcatacggttcggataaaatctgctcgatcgaatccttgcagcgcagacgcggtcccatacggtctgccggaacatccttaaatccatcccccgtccagatattcatgacgcacggcacgccggtctcctttgcaaaatattctgagatgcggatgcatgcctttccgtggttgatccagaactttctggtctcctcatcggggcttgataaggtaagtccgtcttttactttttcgtgggagaaaaacgttgggttgaaatcaattcccatatggtgcttcttcgcaaattccacccactttgcaaaatgcttcggctctaaggcgtcgcggtccgcaaattctcccggctcaaaaatcgcataggacgcatgaatatttaattttgccgttcccggcatcagcttcattgcctcctccatgtcctccatcagctgctgcggcgttctggcgcgccccggatagtttccggtcgtctggattccgcctgtgagtccgccgtcattgtcaaatccgatcacatcgtccagctgccagcagtgcagcgatactggaacctttttcaaccgctcgatcgcgcggtctgtgtccacgccaagtgcctcatactttgcctttgctgcttcataacctgtcatctcgtttctcccttctctccttcaaacttctccattgcaaacgaatccgcaatgcatgctctcgccgccctgaggtcttcaaattctcccgccgcaatcatctgcgcggcaaggttgccgagcgccgtcgcctccgtcggtcccgcctcgaccgtctttccggtgtattctgcggtaagccggtttaaatactgcgcattcgcgccgccgcccacaatgtgaatctctgggtactgttttcccatcaacgcctcgatctcctctgccgtcccggcatagcactgcgcaagactgtggtagatgaccgccgccagttccccgatggtctgcggaacctgctcccccgcttcccgacatgccctccttacttcctccgtcatgttcttcggcgccagaaagcgcgcatcgttgacgtcgatacgcgatgcaatcgtctcctttgcggcgcgcgcacagatctctccaaacccaagttccggcgcactctcctttcggacagactggatcatccagagtcccatgatatttttcagatagcggaaccggcagtcgtaaccgccctcgtttgtcatgttgtgctctctcgccgcactgctgcaatccgccgtcatccgttcggttcccatgagcgaccatgtgccggagctgatatagagcgtctcttcctcctgcgttggcaccgccgccaccgccgaggcggtatcgtgtgtgggcggcaggatcaccttgcaggaaaatcccacttctttctggatctccccccgcaggctccccagttcataccccggcatccggatctcctgaaacagccgtctcggatagcccagctgccggatcagctgctcatcccagtcctttgtcaccgggctgaccagctgggtcgtcgtcgcattggtatactcctgcacctttttcccggtcagaagaaaatgaaaataatccggcatcatcagcagacagtccgcctgctccagccattttggatgctgctcttttactgccgccagctgatagatcgtgttaaaaatctgtttctggattcccgttctgcggtagagttcttcctccgtaatgtgcgcatacactttttcatccatgccctgcgtcctgccgtcgcggtaggctgccgcatctccgatacgtcttccctgcccatccaaaagtacatagtccaccgcccaggtgtcaatccccatgctgtgcggaatttttcccagtctgacacactgcttcatgccgtttaaaatctccgcaaacagccgctcgacatcccataccttgtgcccgttcttctccgtcattccgttcgggaaacggtagatctcttccaataccagcttcccgtcttccagatgggacagcatgtgccgtccgctcgacgctccgatgtccaccgccagataatacgtcgtctccatccccctgctcctttctctttccttctcatttctgctgtcagcataacaaaaataaggacagttttttaggctctgattcgactaaaaaactgtccttattttccattctcaaatgttctctataattctctatgatttttcatcaaggttcccggcatcacgtaaattcatcatgcggtacgcacgcggcgtcacgccgtaccggctcttaaactgccggaaaaaataactcagattctcatacccgacatcgagcgcgatctcctccaccgccagatccgtctccttaagcagatgcgccgccgtctcaaatctccgctgctgcaaaagctccttgaacgtatcgccggttttctgccggatcagcttacttaacaccgagaccgactggtgggtatcttttgcgatcttcgtcagattcgcatttttgcagtcgctcttgatgtacccgagcaccgcctgcacgatcgtctcccggtaatccatcgaggaattgtggcttaaattctcaaggtgattcagaagatataaaaataccagtcccatcgtatactggttcatgacatcctcatcggaatgttcatgcaacatggattcgatcatattttccatgagattttccacctgcggctgctcctttaagcggaacagcaggtagtgcgataccggatttttctgtccgaaagcgccggcgataaattccgcaagcacatttttctcgtgcagcatggaaagcggcacctcaaaaaactccggcagcgcgataaaattgatgccgatatcctcatactctgccctgcggatagcatggcgcacctgctggttcaacatcagcacatcccccttgtgaagcgtcagctccttcccctcaatgatgtgcgtgatgctcccctgcacgacatacatgatctccacataattgtgccggtgctccgggaaatccacaaagcggctgtgcgggcgcacggtgatgagccgtccccgctttaacagcagatcccggtcaatctccccgatcgactctctcgcatacagctgacgctcgaccattccctgtcccgctctgtactttttttcttcctctgaaatgaccatcagttcgttaagaagttcttctctcatcgccgctctgctgcccttctgtaaaactctgcgccccgcctgccgttgtcaccagcacgtctgctctcttctacaattatccacacaggccacacccgttgtcaagtatcagacttctccgaataaaaaaagtggatcttaccaccgttttccgtgataaaatccacttttccttattcctgattatttgtttttatttttccagcccgaagcaatactttgtcaccgagcgatacgtatcgcccgcttttaacaccggtgatttgaaattcttctcattcaccgcattcgggaaatactgcgtctccagacagaatgcatggcgcttgccgtactgcacgccgcccttgccggtctgcggcgtgataaagttgccggtatagagctggatccccacacagtccgtatacacatccatgcagatgccggactttgcacctctggcgcgcgcagcaagctgcatggtgccgtccgccttgtccagcgcataattgtggtcataaccgcccgcataacgaagctgcgtatcgtccgcttcgatgtcccgtccgatctccttcatctcccggaaatcaaacggcgtcccggctacttttgcgagttctccggtcggaatcgccttggaatcaatgactggcgtatagtaagatgcgtgaagttcaagcttctgcccttctatcacgccggaatcatgtccgtccagattaaagtaggcatggttcgtaaagttcgccaccgtcgtctggtcgcagactgcctcataggcgatcgcgacctccccgttatcgtccagcgtgtacgtgaccttcgccgtcatattgcctgggaaatcctgttccccgtcgcggcttacataggaaaacgtaatactctgtgcgctctcctgcaccacatcccagatcactgcgtgaaaaccgtgcgatccgctgtgcagattgttctcgttgtcatttgcttccagcgaatagtcttttccgtccagatggatgtgtgcatgatcgatccggttcgcattgcgcccgatcacagctccgaaatagcaggtattgttctgataatcaacgggtgtatcgtatcccagcacaacgtcatatacgtttccgtctgagcccttcattgtgatcgatacgatcgttgccccgagatcaatgacagaaagcgtcattccctgcgcattgacaagcgtgtactccgtgacctccctgccttcctttgtttggccaaagcttcgtttttgcatactgatcctcatttctaagcatatttattgcgaaacggcagaccgtttcttctgacgtactaattctgtccgtagtaggcatttgccccatgcttgcggtagaaatgcttttccttgatacaatccggcgccggcttcaccttcggattgataagctcggtgttgcgcgccatcttcgccacttcctccagcacgaccgcattgtggactgcctctgcggcatccttaccccaggtaaacggtccgtgattcgcacagagaaccgccggtgtgtacatcggcttgatgcctcttgtctcaaaggtctcaataatcacaagtccggtgttcttctcatatgcctcgtcgatctcctccggcgtcagatttctggcgcacggaatcggtccgaagaaatagtctgcatgcgttgtgccgtaaagcggaatgtctctgcccgcctgcgcccacgcgacagcctccggggaatgggtatgtacaataccaccgatctcctcgtactttttgtagagttcgatatgggtcgccgtgtcggaggacggcttatatctgccctcgatcttatttccgtcaagatccatgactaccatatcgtccgggcttaaggcatcataatccacaccgctcggcttgatgacgaaatagccgctctcgcggtcgattccgctgacattgccccaggtgtaggtaatgagccctctgcgcggaagttccatgttggcttcatagacctctttttttaattcttctaacatctcttagtttcctcctgtgctgcgccgttctacttcatctcacgcaggatgcggtttgcgattccctctgcatccagttcgtatttgtgaagaagttcttttgccggaccggattcgccaaagacatcgttgacaccgattctggtaatctttgtcgggcatttttcaccgagcgtctccgccactgcagcgccgagtcctccgatgatggaatgctcctccaccgtgaatacgcgccccgtcttttttgcagtctttaccacaagttcctcgtcgagcggcttgatggtgtgaatgttgatgacttccgcatgaatgccctgctctgccagcgtatccgctgctgccagtgcttccgagacacaaagtccggttgcaatgatggagcagtcgcttccctcacggagcgtcacgcccttgccgatctcaaacttataatccgcgccgtcgttgatgaccggaaccgccagtctgccaaagcgcagatacaccggtcccacgtactcgtaggcagccttcactgccgcgcgagcctcgatgtcgtccgccgggttgatgacaaccattcccgggatcgcacgcatcagggcaatatcctcgttgcactgatgggtcgcgccgtcttccccgacggaaattccggcatgtgtcgcaccgatcttcacattcagatgcggatatccgatggaattgcgcacctgctcgtaagaacgtcctgccgcaaacatggcgaaggtgctcacaaacggtacaaatccacatgtggacattccggctgccacgccggtcatattcgcctctgcgataccgcagtcaatgtggcggtccgggaatgccttcttgaacattccggtcttggttgccgctgcgagatccgcatccaagacaaccagattctcatgctctcctccaagctcgaccaaagcattgccgtagctctctctcgttgcaatctttacttctgacacaatgcttcacctgcctttctaagatcctccatcgccactgcgtattcctcatcgttcggcgcttttccgtgccagccgacactgttctccatgtaggagacgccttttccctttacggtgtgcgcaatgatcgcggtcggcattcccttcgtagttctcgcctcatcaaacgcccgcttgatctcatcgaaatcattgccgtcgatgttgatgacgtggaaattaaagctctcgaacttcttgtcgatcgggtacggcgagcagacctcgtcgatcggtccgtcgatctgcaggttgttgttgtccacaatcacgcagaggttatccagcttgcggaaacctgcgaacatggcagcctcccagatctgtccctcctcgatctcgccgtcgccgcaaagtgcatacacacggtaatcctgctgtttcatcttccctgccagagccatgccgcacgctgcggaaagtccctgtcccagagaaccggaagacatatccacgcccggaatgtgcttcatatcaggatgtccctgtaaatacgatccggtatggcgcagggtcaaaagatcctccaccggaaaataaccgcggtttgccagtgccgagtaaagtcccggcgccgtgtgtcccttggacagcacaaaacggtcgcggtcctccttcttcggatccttcggatcaatattcatctcttcaaaatataaataggtgaagatatctgctgctgagagtgatccgcccggatgtcccgccttcgcgctgtgcacggacgatacaattcccttgcggacttcaacagccatcttctgaagtgccagcttatccatagttcccccttcatgcattctttgtcattgctactgcaaaactttgtcatcaaataccgcagagcatcttcggtaattagtcaccaaatacagctctgtagtccgcctggaatttctcaattcccgcatcggtaagcggatgcttggtcatctgctcaataactttgtacggaaccgttgcgatatgtgcgcctgctaatgcacagtctgtcacatggatcgggttgcggatcgatgcagcgataatctcggtctcaagtccgtagttgtcgaagatctgcacgatgtcctggatcagatcgatacctgccgtgctgatgtcgtcgagtctgccaaggaacggagatacataggttgcgcctgcgcgcgctgcaagaagcgcctggtttgctgtgaaaataagcgtcacattcgtcttgattccctctgcggacagcactttgactgcctttaatccctctacggtcatcgggatcttgactaccatgttcggatggatcgctgcgatctcacgtccttctttgatcatgccttctgcatccacagtggttgcttttacctcgccgctgatcggaccgtcaacgatcgtcgtaatctccttgatgacctcgttgaaatctctgccctctttggcaatcagagacgggtttgtggtaacgccgcagatcactcccatatcatttgccttgcggatgtcctctacgtttgctgtgtcaataaaaaacttcatattcctctccctttctgcgcttgtgcgcgcaccctatatgtgtatccgggtctgccccggtaccattctcatttaccgggggatgccgttttgacatccccgtatgcttcttattgttttttagcggtaaaacagattgccaagcatcagatccttcttgaactcgcggatctttgtatccttgtcaatataaactgcctcgatgcccatggcatttgcccagtcgcccatctgctctgcggtgaggtcgtaggtaaatgcggtgtggtgtgcgccgcctgccaaaatccatgcctccgcaccggtgtagagatccggctgcggtgtccagtaattcgttgctaccggaagcttcggcatcggcttctctgtcttcttacagtccacatcgttgatgatgagacggaaacggttgccgagatcgatcaaggatgtcgcgataccgcttccttccttggaggtaaataccagtctcgcagggtcttctctgtcacccatggaaagcggctggcacttgatggaaatcgggccgtctgcgatggacgggcagatctcaagcatatgtgcctcgaggattccctctttgccttttacgaaattgtaggtgtaatcctccagcatggaagtaccctttgcctccttcttgcctgctgtcataatcttcatcaggcgcaccatcgctgccactttccagtcaccctctgcgccaaagccgtagcctttttcctcgaggcgctggattgcaagtcccggaagctgctttaaggcaccgagatcaccgaagtgtgttacgattgcctgataattcttctcgtccaggaaacgctcgaaaccgatctcgatctgtgcctgtacggctacatggcgtctgaactcctgcggatcacgtccctctaataaaatgtcatatttgtcataatactcatctaccaaagcgttggtatcggactcggatacagctgcaactgcctccgcaatctcgttgaccggataggtatccacttcccagccgaacttcagctgtgcttcgaccttatccccctcggtaacagctacgtttctcatgttgtctgccacacgcatcacgcggatatggctgctctcgatcacgccgactgctgtgcgcatccaggatgcaatgcgctcctgcacattgacgtcgctccagtgtcccacgactaccttgcgctcgattcccatacgtgtcacgatatgaccgtactcacggtctccgtgtgccgactggttctcgttcatgaaatccatgtcgatggtgtcgtaaggaatctcctcattgaactgggtatgtaaatgaagcagcggctttctgtactcctgtaatccgagaatccaggactttgccggggaaaatgtgtgcatccatgtgatgacgcctgcgcactcctcatctacatttgcctcgttgaaggtcttacggatcagttcattggtgatcagtgtcggcttccataccacttcatacggaagcacgccggactcgtttaactttgccacgatgattttggaatgctctgccacatgtgcgaggcactcgtctccgtaaagatcctgtgatccggtgcagaaccagaacttgtaattttttgttgctaacataatgttccctccatgaaatatatttatgtttcagcagtaactgctgtgtaaatcccaatctgtaagcagcggcagcatctgccgctgcccccgtatctgtctataacggcatcgtccaggctgccgccttcgtgcctgtcttataacggcatcgtccgggctgcctctttctctgttgcaagcgccgctttgtacgccttgatgtaagcgtcaaatcccgcaacatccgccggatccggctccatcacgcttccggactccccgccgaagactttttcggagaggtactgctccaggctctcgccgtccgctttctgcagcatgtaggatgccagcagcgccatgccccacggaccgccctcgccggctgtctccatcactgccaccggcgcatccatcgctgcggccaaaattccctgtccgacgcccttggtcttaaagagtccgccgtgtccgtagatgcgatccacttttactttttcttccttcagcagaatatccagaccgatctttaaggttgcaagcgctgcatacagatgtgtccgcatgaaattggcgagattaaaatgtgcatccggcttgcgcacgaacagtggccgtccctcgttcactccggtcaccggctctcccgagaaatagttgtatgccagaagtccgccgcagtccttgtcaccctccagcgccttattgtaaagctttccgaaaagctcgttcatatcgacattgattccgaagttctccgcaaactcccggaacagaccgacccaggcgttcagatccgaggtacagttgttgcagtgcaccatcgccacggtatcgccggacggtgtggtcaccatatccagttcctcgtgtaccgcctttaagtcttcctctaaaaccaccattgcaaacacggatgttccggcagatacatttccggtgcgcacagccaccgaattcgttgccaccataccggtaccggcatctccctccggcgggcagagtggaattccggcttccagcctgccgctcggatcaagaagctttgctccctcctctgtcagtgttccagcattctcccctgccacgagcaccttcggaagaatctcctctaacttccatgtatatttccctaccgcaggaagcgcatcaaactgtgccagcatcttccggttgtaatctcttgtcttcgcatcgatcgggaacataccggatgcctctccgactcccagtaccttctccccagtgagtttccagtgaatatatcccgcaagcgtggtaaaatatgcgattttatccacatgctcttccccgtttaagattgcctgatacagatgtgcgatgctccagcgctgcggaatattaaacgagaactccttcgtcagtgctgcggccgcctcgcccgtgatggtatttctccaggtgcggaacggaaccagaagctcccccttcccatcaaacggcatatagccgtgcatcattccggaaaatccgatagcaccaagctttgtgacggcaacaccgtatttgttctgtacatcctcggtcatcttgcggtagcagtctctaagaccgtcccagatcatatccaggctgtacgtccagattccgtcgaccagctgattctcccagtcgtgcgcgcctgacgcgatcggctgatgtgtctcgtccaccagcactgccttgattctggtagaaccgaactcaataccaagcaccgccttcccgctctcaatcctctcctttgcgtttcccatgtgtaacaaacccctttccgaaaccatgccgcatctctcatacacccatgatttccctgcactcatcttgttgatgttatcttaagcataaaacttgtatgctcgtaataacaagttgttttttattcatttttatatcgtgtggttctctattttttatctatccggaaaacatgtacaccgtgtgccgggatttcatccgaaaggcagtcattgtgcacaatgagttccgttccatcccagagttcccgcgcacggatggttcctggctgcccgcacatgtctgcaaacgcttccgtctccggcaatgcagcctcacactgcgccggctgctccataaagttaaacagggcaagataccgttcgccctttttttcattaacacagctccagaccgcatgccgcaaatcgcgcgccacctgcctgcccacatagtctgcatcgagcatctgcaatagttcctgtctcgtcagaagaaaacgcgtccagtcatccagcttcgtcagttcaccgccgatcattaaaggcgagccgaacatacaccagagcgtcatcatcgtcttctgctcatccctcgtaaagtttgtctgccgctcctgcccgaacccttttccgagccggccgaccggcagcatatcgcagtccggaaacgatccgcagcccacatggttctgccacagttcacagcgccggaacatgtcgtagagcagctcccacgtatcccagaaatcatccgtgatgcgccacatgttggcataggtttcataatgccatgccttttcgatcagcgccggtcccggcgacagggagagcacgatgtcccggccgcacttttcaatcgcatgctgcagcatttcgatctcatgcgccgccgaatacggatgttccacgtacagattggtattgcagatatcatcgcatttgataaaatccacaccccactgtgcgtacagcgccacgatggaatcgtaatattcctgtgcgcccggctctcccatacggatgccgtacatgtcgggattccacttacagatcgacgacggatccgctatatcgctcgccagcgcgtcgcttcccaaaatcggcagatgccggtgtgccgcttcccgcggaattccccgcatgatatggattccaaactttaaccccagcccgtgcacataatccgccagcgcccgaaagcccacgccgtccttcgccgacgggaagcggtccgtacaggggagcagccgcccgtactcatccatcgacacctccccaaacggaatatactgatacttctccctctgacttccggtgttctttgcataccactggatgtccaccacaatatattcccagccgtacggttttaagtgcgccgccatataatccgcgtttgccctgacctcccgctccgtcactgtggtgtcgtaatagtcatagctgttccaccccatcggggcatgtttcatccggtatttcatgcttctctccttctcttccccattcacgatatttcctatagaacacaaaaagccgctgcagatgcagcggctttttgttgtcatacatcctgcttccaagtgtatgacttgtactttcgtacttacaagttgtttttatcgtcctgtgtcatgtccgtatcgtctcttcttctgcaggattcccgaatcacaagttccggctccatcaagacgcattttccttcgatattggaattcccctcccggataatccgaagcagcagttcggcggctgccgctcccagttcctcctgcggatgggagatcgtcgtcaacggcacgcggcatgtctgtgccagataggaattgtcataccccgtcaccgaaacatcctggggcacggagagcccctcctcattcagcgcgcggatcacctcgatggctacctgatcgttgtacgccaccaccgcctcaaacggatgattgccgcgatctctcgccatctgcctgatccgctcaaacggatgggtcttgcggtcctccgtgtagaaccagatcaccttatccggatcatacgcaattcccgcttcctgcaatgcctgcacataccccttgtggcgctgctgtccctgcgtgtcgtcggatttgaagacgcccacaatgcgccggtgtcccagttcaatcaggtatctggtcgcaagataggcgccccggcagtcgtccaggagaatctgcggccggtccagaagctgtgcatgtactccctggataaatacatagggaatatgatagctgtcgagcatctcatacagattcacatgccggcagaaaatctggctcttgctcggctcaatgatgagtccgtcaatatccttctgcagcagttcctcgagacacttcgcctcaaggcttctcgagttgcgcgtattttttaggagaatactgtaaccgttctccgtgagcacctggtcaattccctgcacaatgcgcggaaaaatgtaatccgaaagataagttgtcacaaccgcgatatttttggatggcatcgtgtgccgtaacatctccgagcagaaggttccgcggccgtgttccgcatatatgtatccctcattctgcaaaatctgcagtgccttgcgcaccgtctgccggctgaccccgtactccgccgacagttcattctccgagggaagcttctctcccgggcgtatctcccccgacatgatcttgccgtggagctgctccatcagatcataatattttaatctcttatccattccgtccgatccccctgaatgccttctctctttgcgcgccgtcagcccgttatcccgacagcctccttcgccaggcggtctgcctcctcattgcccatgacgcccgagtgtccctttaccttcacaaaagaaagccggatcttatcctccaccgagcgcacatactcgtagtaggccaccgtaccctttttattgcgcttccagagtccttttgcccacatctcgattcccatataatcgtaatagatcgtaagatcctttaagccaagttcgagcgccttttcgatggctgccatgctcccgaaaacctcgcctgccacattgcgcatcgacgccatctccggctccttccccgcaccctgcagcacttcttttccgccggcatgaatcaaaaaacctccataaccgtacacgccggtaccggcgtgaaaagagccatccacgaacgcgtaattctccggcagatcctctgtctctccggcagattccgcacctctcgtctctgccttgccgtctccggctgttcctgatttctgctgtgctgctccttgcgttgcattctgctgcgccgctccttttgcatgagcttctcccccacgcgccggtgcgctttccagaaacgtctccgcttcttccagcgtcttaaaactcttgtaaaccgctccgtggaacccgtgcaccatcgccttacactcgtcccattttgtgtatattcccggtttcttaccaaccgctaccgcataatattttactgccatctcgtcatcctttatttcgatattttataatacaatataccatataattcccgcacataaaaggtcggaaggtagagaaaaaatgtccggctcggtgtgctgtagcttgtaatgccaagtctctttgccgtctgattcgcccggtactcatggaattcactggttataatcgtgatgggtccgtcgattccgtgctgttgtaacaattccatggaatattgcagattttccgccgtcgtcgtggaccggtcctccagaagcagtctcgccccgtcgatcccccgcccggtcaggtaacggtacatgcactctgcctcgctgatctcctctccatctccctgtccgccggataatacgcacacagcttttggattccggttcagatactcatacgccgcgcaaagccgttcattcaacacccggctcggccgctcccccttgacgctgcatcctaagaccaccgccgtcgtattctccggcgcacggtttgccgcgcttcttatcatccccgccgtctccactgtcacgataagcagaataaaaaggagcaccatgcccagggcggacaatcccgctctgccaccgcgcgtctgccaaagtctccctgccacatcctgtacctgccggtaaaaaataccgtacagcagcacaagggctgacaccgccattcccgtaatgttaccgatattaaccacgacaaatgccggaatgaaaaaccacaggaaaaatacggctccaactgccattatccaccaatgcatccgtgccatcttacctccctcaaaaagcaatgagcggcacgccgaagcgggccgctcttgtcctctcttgttacaaatcttgttacgaaatctccagcttacagttcgcacgcatttttaacggacattcataaacgttctcattattctcttttgcaatgtaagaaagcggacactttctgcagtcgcctttattaaaatctccgccaacctcaaattttaaggttgccgtcttcacacccttcaccatctcttcctgccggatgtgatcccagctcaatacctggctgcaaccggcacacttgctctcgttcaatgtcaccacgcgcttgcaggtcggacaggcataaaacttcttaccggacggctccaccagttccacaacttccgccggaaactgcttaatcaattcctctctcaaattgtcctgcatgatccaatcgctcctttatcctgagtttgcactggtactatcataccacaaaggcggcggtactgtaaaccgctttccttcgttttccgctcagattccgtttcattattctccgggttccgctacttttccccctgttgctgccggatcatgtccatgatgtaatcgatcgtttcctgccactgctccctgtccgtaatcccggcctcgccgtctcccttctgcgatccgtaattgccgaacccggcatggttgccgccctctaagacatactcgcggcagtccgccgcaagaccgattgcttcctgatatttttccatattcaaaacgccgtcctcgctcccgtagagcgagagcaccggaagcgtctgaagtttcctggtcgggtacgccgccagaaaaataagtcccgcgagctctgactcatgctttgccgcatagctgcccgccatggctccgcccagagaatgtcccgccagataccagcgctttacctctccaaactcctgccgcacctcatccgccgcattcggctttaaaatggcaaggtgcgccggcatctttaccgtcacgcaaaagattccctgctgcgcaagcccatccataaccggtgcgtacgccgtctcttccaccttggctcccggataaaagatcagtcccgtctcactctgcggatctccgtaagcgatgtaggcatccgtctccgatacctctgttgtctgaagttcatagtccttcgcatgataataatctgccgtataggtattaaatcccacaatcacggctgccacgattaaaaccgtaaaaataattctgcgcaccgcttttgcatgcttcattgtctctcatcctccgacaccggaatctgcttccgttactttcggatatctgcaaccacctcatccggaatgacgaactgtacgcatcccatatacatcggtgccacatcaccctcgttaaagcatatcacaagatggccgtccgaatccagataaaatgaagtctcatccgtaattttgtcaaaattccattccggaacctcggcattatccacccagtacatcttaccgtcatcctccgccatctgctgctgcatctgctccttgatattctcgctgatcggggtgatataatccgcgccactctggaataaatccgaaagtgtcagacgctcccccgtctttaagtcaatcgtataataatagtcccactccgcgccgctgcctgccgcctgatagcacatcagctttaacgtaaagtaatcgtcggtcgtgctgataacttcgtgcttgaccacgacctcctgatagccctcttcttccttcctgctctcctcgaactccgatacgatctgatccgtaatcttttcaatctccgcattgatctctgccgttgtcttttttaagttctcctgcacctggacctcagtgtccgtcatctgttccgtatcgctctcctttaccgtcagctccggcgtcttaatgtccgccgcatgacctccgttgtcgtactgataatcccggaacgtcacagcctccacgagttttccgaccaccggtagattccccatggcatacgccacgctccccgaggtgttcggcagcaccacgaagactgccgccactgcagcagccgctgccacaatatttctcacggtatgcatttttctgctctcgtttcgtttttccatctttgcttcctcgatccgttttttcatctgctccacctgctcgccggacatttccgatccggcatactgtcgctttaattcctcgatctttttacaatcctgtttcttatttcccatatgcggcaccatcctttcctctattcccactgccatgtatccgtaagttccagccgtagcttctttaatccgcggtacagccggctctttaccgtattctggttctcccccagcacgcgcgcaatatcctccagcttcatgtcctcaaaatagcgcagttcaatgaccgctttatcccgttcttccatggcgtccaatgcccttcttagatcaatgttctcatagcggtcttctcttccctcttccgccggcatctcatccagggaaacttcccggttcttttttacatatccgaagatctcgtttaacataatgcggtaaatccatgtctgcgcatattcctcctgctttagcgcatcgctgtttttgatcgccttgtacgctccgttctgtacgatatccgcggcatccgcctcatgatgtacgtaactgtaggcaagacgatagtatttgttgtaattttccagcaaaagctgttctatcttttgttccttatggtttttcccggagaaaaacatacgatctcacacctccttttaactattagaccgtccggacaccaaaaaagtttcgctgccgtataaaaaattatattttctccgatccggttccgttttttccactctcctgtctgcacagttccgtcaaaaaccggtacattccctcctggtaaatcgggcgctccaccacacaatccactcctgcggcaagcatctgacactccaccagttccttctcattggtcgaacagcagatcgtaaggcttcccttcggaaaattttcccgcaccgaccggataaacggctcaccgccctgcatataccagttcacaaaacacagatcataggcgttgcccttagacgcggctctccttaaatacgccacggcgtccgccccgttttgcaccacgtcaaccggaagcccgagacgcgcaagaaccgctgcatgataatctctcgacagttcattgtcgtccagaagaagcgtctttaaccccgcaaaacttttaggctgtccgatcgcttttccgattccgaaaggcaggaacaccctgcagagaatctgcgcatcctcctgtacttccacacacatcgttccgtgcaaaagttctacgaggctcttgatcagcggatagtcttctcctccgtcaatgctgccctgcacggcaagttccagttcaagctcatcctcccccgttcttacttcccgatagcctgtaaaaatccggcatcccggccgcgcgttgatatacgctttctttagcagtcttgcccagatctgcttgagcctcctgacatcgcccaccagatattcgcagaaaatctcaccctcctgcaccgtcacctcaatccccatttccgtacagattgtcctgcactctgaggtcagttccgcaaccacatccgaaatctgaaaggtgtcgcagacactctcgcccgcacctacaatctgcccgtccaaaacactgtccgtcagttcccggatgtgctccagatgcctgtacatatcctccagtcccacagacttattttccgttctctgacctgtcatttctctgtaacactcctcgattaccgcgacgtccgtgcgcaccgtccgcgccacctgaaacagcagatgttctctgaccgtgcttaaatgccgctggctctcaagccgctccgccagtgtctcatagcgtgtcatgatattgaacacccgcttttttaccacctccggctcgcagggagaaaatataaaatcgtccgcccccatctctaacatttcaagttctctctcctcaccgatgaccgtcttcacgatgaccgggatatcgagaagcttcggatctgccttcatctgctttaatacctgcttcccgctctttacgggcatacacatatccagtatgacaatatccactttccgctcttctaaaatttttagtgtctcatttccgttcccggcttccagcacctcatattcctcttcaaacattgcgcgaaacgacgctctgtttacgtcgatatcatccgctaccagcatcactctgttcttttgcattgattcggctccattcttttatcgtatcggtaacatatcttttaaaatataacataccatcttttatttctcagcaaaatccgtaccgttttttaacatccagcgcccctgtccttcctcttctacaaaattcgacacaaaaagggactggtgcttgaagcaccagcccctttttcttctcaacggtaaatcatactgtcgaggacggcatacatctgtgtaatctcaatcggcttgcttaagtgtgcatccatcccggcatcgagggactttcgcacgtcctcctcaaacacattggctgtcatcgccacgatcggaaccgttttgccatcctcacgtccggattcccggatctttctggtcgccgtcagtccgtccatgaccggcatccggatatccatcaggatgacgtcgtaatatccgggctcatgggaaagaaaatgcgtcacgccctcctctccgttgaccgccacatccacctgcagattcttgtgcagcaggatattgcgcgtgatctcaatgttgacctcattgtcctcgaccagcagcgctcttttgccggtaaaatcgtagtcgggcgcctgtacatcgccctgtccccgcagcttttctccggaatttctgacacgctttaagttcacattcacaatgaacgtcgagcccttgcccttttcgctgtatgcgtcaatgtgcccgcccataaattcaataatgttgcgcgcaatgggaaggccaagaccggtaccgccgtttagcgtcgtgattccttcatcctcctgctcaaacggctcaaacatatgcggaataaacgcttcgtccattccgactcccgtatcccggatctcaaaccggaagccggcatcctccccgtcatcgccggtatgctccacaataaagtcaacctttccgtccggcatcgtgtattttacggcattctccagaatattggaaagcgcccgctccagcttctccgcgtcaaagcaataggtagcatcaaagcttccgcgtctgtccaccgcaaagtgaacgcgacgctccgccgcctgccgcatcgcctcttccaccgtctcctccaaaaaggcatctaagaccaccttctggctgttcaatgcgacgttgccgctctcgatctgggaaagatttaaaatatcatccacaaaagacagcataaaacgggctgactggctgatcttgtccagattctcgagcacctgcttctcattgttcacatattccctggtcagatacgtaagacctatgatggaattcatcggcgtccggatctcgtgactcatgcgctccaaaaattcattcttctcctgattggcatgtcttgcgtcaaacagcgccgacatcagtctctcctgctgccgctgttcttcctcatagctctccgtcacgtcccggcgcaccaaaaccaccgtgtcacggtcatcctgctgataagaaatatgcagttcttttctgcggtatacctccccgcacagcaggcggtacgaaacaaccagatcatccctctgttccagttccgagagaatatgcggcagttctaacgcagccgcgcatgcctcccggtccttgggatgaacatacagcggtatcatctgcgcatttacctgtgtataatctccctccggcggcggagtcacatccgtatcgtcattggtcacgatcacatgaaatgttccggtatgtacatccacataggtaataaaatcgagttccgacttgatgacctgctccagtattccgcgctctttgatggatttcgcgtctcccattctgcatactcctttatttcaaaaaaacaaactatgctttattataacaggatttgaaaaactttccactgcaatttttcatttttccccctgaaagtgcagttctacctacggttcgggcatgtgtccctcctgctgcaatgtgcgcagattctgccgccatgtgccgtctccccgcacgcctccgccggcgcaagctccatctcaaacaccacgcttttcttcggtttcaggcaataccctgccgtacagacgaccttgtgctgttttgcccgcgctaagatctccggcatcgcagacagcggatgtgcttcgtcatcaccgaaaaaatgatatgccgccacctgatacccggtattctcccgtatccatgcctccagcatgccatagcctaacatcagaagttctccgccgatactctcaagcatatagctttccagcatgcgtccggtgttctggtagcgttcctgcagcaggtccacatcgcttccaagcgtcacaaccgcagtcgcccggcgtaccgtatccgtcccatcctcaaacatcagatacgccgcttccttccatttcaggcagcccgccagatcggatgccacacccttcaaaagcgccttatctttttcctcaaaatgataccggctcctgacctgttctaaaaacacacttgtcagacaggtccagagccggctctctatgtatcttcgttccacactgcgctccctttcctgctcttattgtactgcattacagagtcggtgttgtgctagtaaagccgttttcgcagtcccttcgggtaatgattcttcatgattccgcccgcgagctttccccagccggtactgtatccgtccaccgtgattaaataccagcccttttctccctgcgccgggaacgtctccccgtttaggtatccacggatctcccgcccgtccgaaggaagatccatcgtatgtaaaacatccgccgcatgaagtgtgagcgcaagtgcgtgtgaaggctcaaatctgcctttcttcgccgttcccagatgcagtcccgggcgcagcaccttaagaccttttaccgacggcatgccctccgggatccggtagagctgctcgccgaatttcagatagcggcactcccgtcctgcatacttctccaatgcgtccccggcgaaagtctccccggcaaatgccagatattccgggatgcccgccgcagcgctcttagaatctcctgccgcaagtccgttctcatacccgttctttaacagacccgatccgccgtccgcaagcgttccctccttgcgcagcaccgccacataatgtccttccccgcgaagcttatgcggccacagacggatcgtcgcggaaagttctcccagtccgtgcgacattccctccgcaagcggcacctcctccacgtagaattccggatgtctctccaggaatcgcccgatacttccctcgtcttccgccggtgcaaatgtgcaggtcgaatagaccagtctcccgccgcccgcaagcatggatgccgcgcagtctaagatctcatcctgtctgtcggcacacagttctacattctgtgtgctccactgctcacacgcctcctcgttcttccggaacatcccctcgccggaacacggtgcgtccaccatgattctggtaaaatactcactgaaatgttctgcgaggcgctgcggcgtctcattcgtcaccaccgcattggcaattcccatgcgctcgatattctccgagagaatctttgccctcgccggatggatctcattgctgatgaggattcccctgcctgccatcgccgccgcaatctgcgtgctttttcctcccggtgccgcgcacaaatcaagaatccgctcgcccgcaccgtctgccatctgctgcgtcagatacgctgccggagccatggcgctcggctcctggatataatatacgccggcttcgtgatacggatgttttcccggcgtatcctgcgccgtgtaatagtagccatgctctgcccacggtacacgctccagcgagaataccatgcggtttaaaaatgacgcgtcgtcccccttctgcggattcaagcgcagcgcctggtagcgcgctatatcatagctttttaaaaatgcaggatactcctcccccagcatgttctccatccgttccaaaaattcctgtggcagcatctttctctcctttgtctctgcatgattctctgccgcctattgtagcacgaaccgtcccccccggcaacgcattttaaatgcatgcccctgaacaatacttactgcatttaaaaatggcgcgtgagaagatcacttttttccagaaaatcctccacggtggaaaatcccagcttttcaagcaattcgattacataagggttctccagaggtgtctgatacaatgcctcttttccgtaatgatccacgtaggcactgccctcttcgcgcggcagcagcgcccgcggtcctccgacacagcctccgacgcatcccattccctcaaaaaaattagcctccgtcttcccctcctggattgcctcaatcatctgcttacacgcctttccgccatccgcctgcatggggcggaccgcaattttccgtcccgggtgaagttgttctaccgtccgcacgaccgcctcgctgacgcctccggtccgcgcatagattctgcctgctcccgaagaatgttcgcttgcatcctcctccatctgctgcggcgcaatccccattgcctcaaacagcatcgccgtctcctgaaaggtcagcaccacatcaatcgcatcgcagatatccggctccttcgcctcctttttcttggcaaggcacggaccgataaacacggtgacggcatccggatgcatctttttcaccgccctgcccgcagcgatcatcggagacaccgcccccggcatatacggtaccagttccccgtaaatattgcggatcatggacacccagaccggacagcagcagctcgtaagcaaaaaatccgtatcccggttcacatggcggtcaaattcaagcgcttccttcaaggttaaaatgtcggcaaataccgccacctccaccatcccggaaaatcccgcgcgtttcaatgccgcacggattgctcccggggagaccccctctccaaactgtcccataaatgccggcgcaatcagcgcatatacctgtttttccggtgtaagcagcacttcgcgcaccgcatttaaatccgcgaacttttccggaaagaccgtctcacagaccggaattgtgcgctccgtcttttcttctcccgccaaaagcagacagtccatctgatcatatcgcatttcttctttcctctgtttctccgctttgtgctctctttttaatatttcctcatgcaatctgcgtatgctctccatctttcacacctgccttttctttcaaggatgcccatacatcctcctttttattcttcgcacacttttccggttgtagtttgatgcacaaaagaaaaagccatccgttcctgccggatgacttcctcttttgccccgggagccaaaactcccgtttcttctaatcatacagaccgatgtgatacttgaacttgcggtatactttccatccaaagattaccggcatagccagcaccagatatgcagtcgataacattccggctgctccaccaacgatcatcagaatccatattaaaatattcatagtttttatcctctcataaaataataattgctattttatggaggatacaaggccgttcttttttccgtcggccctccttatgtatgctacaatccttcttcccgagggaatcagttcccactgctgcccgcgctctctccccgccaaaagaaacagcgcgcccaaaagtcccgccagaccacattccagaagccacactaggagccgaagctgctggacattccggtagcggtaggcactcttctgcctcagcgtctctatgacatgcgcctcactcagttccctgcctgcggcttccacttccgggcgctcctcgttcggtgacgcgaccatggtgccggtctgcttacggtccggacaaaattcctgtccaccggtctgccccatccgcttcacactgtccaaaggtccggactcccgcactccgtttggcagtgccgccgccacaagcatcgcggctatgagcaaaaggcagagatggcatttaaagaattcccctgatcggattgatttcctttgcctttgcaaaaatctcatcatttttactctccagatactgctccagtccgcggacttcttcgtccgtaaagccctcattcttcgtcacgcggcatgccggcaatatggcttccgcgacatcccttccccgctcaaaacgcacagacacacagcgtctgccgtcttttgcaaagatacccgaatgtgtcagtctgacttcttcttcccttctcattccaatctccattccggaacaaaattactgctgttcctccaaagatccgtcaagcacctggcttggcatctgatcccgcagatagacctttccatggtcttttctgctgtcgtactctgcctgcagctgccggttcttctcctttacttcctgctcaaactctctcgccgagagcaggatgcatccggctccgcggataataatctgctccagcccgtcggaagtggcaaccgtcacgcggtatctcgacgcgtgttcatgggcgaaacgctcaatatacgcgtccgccgtctccgcctccttcgtgtacaccacatgaatattgtgataatcacacgcttccgtctgatgtccctcgacacggtacgcatcgaataccacaatcagctcacatctgcggattccctgatagttgcagagaatatccaaaagccgcccgcgcgcgctatccatattcactctggcaagttccgcaagttcctgccacgcaaaaatcacattatagccgtccaccagcagatattccacgccggcatccttctgcttcccgcctccggaagcagaagcgggactgctttctatgatgcgcttctttttatagccgttcgttgcgccggcatctttgtctctcttattagcattgtatgtccggtcaaggattctgtcaatctcttccgtgccgatccaggcttcttcctcccccgtctttgcgtggaaattcgccgcatccggcagccactgtccgggataccattcctccccgttcttatcctgcccgagcaccggcggcaggtgcatataggaaaacacctgatcccacggcacaatgaatcctgctccgtgcgcacagaatacagaatccgccgtattctccagatcactctgggcatcatacccgatctgcgccaccacttcctccgtgttgtgacagggaaaatatccctttaaggcaaccgaaagcttcccctctcccgcggtgtatgccatcacctcacgctggtaattctgcatggcggacacgggcgcacttcccacaatgcagccgtctgcactgtaggcaatcgttcccttcatgcggtcgatatcattcatggcgcgtccgaccgctcctgccggaagcgagagtctgaaatcataccacggctccagcagcaccgtttccgcctgcatcagtccctgacgcagcgcacgataggttgcctgcctgaaatcaccgccctccgtgtgctttgtgtgcgcgcgtccggcaacgagcgtgatcttcatatccgcaagcgccgatcctgtcagcacaccgacgtgttccttctctcttagatgggtgagcaccagccgctgccagttgcggtcgagcacatcttcgctgcagtccgtctcaaatacgagcccgcttcccggctctcccggttcaagcaaaagatgcacctcggcgtaatggcggagcggttcaaaatgtcccacgccctccaccgtacctgcaatggtctccttgtatacaatccttccggcgccaaatgtgacctgcactccgtagcgctgacggatcagttcgctcaaaacctcgatctgtacttcccccatcacctgcacctggatctcttttaaggtctcatcccacacaatgtgaagctgcggttcctcctcctcaagttcccgcagtctgggaagcatgactgccgggcttacctcttccggcagtatgatctgataagtcagtaccggctctaacaccggcagcctggacgctttctctgcgccaagtccctcccccgggaatgtgtgaagcagacccgtgaccgcacagatgcctccggcgccaacttcctctgccgtctcatatttttcgccggaataaatgcggatctggttgatcttctcctccccgatgacctgtctgacttttaagcttccaccggtcacttttaagtaggtcaggcggtttccctgcgcatcccgtgcaatcttaaatacccgcgcgccgaatgtctccccgcaggccgggatactggcataccggataaagtccgccagaaactccttcaccccctgcatcttgagcgcagatccgaaatagcacggaaacagcttacgttcccggatcagctttctgatctgctccgttccgaccgcttcccctgccagatactgctctaagacctgctcatcgcacaccgccacattttccgcaaaagccgcgctctcctgatccgaaaaatccacgcagttctcatgcagttcctttttcaattccaggagcagcgcctcctgatccgttcccggctggtccatcttgttcacgaacaaaaacaccggcacctcatacttcgccagaagcccaaacagcgtcctcgtatgcgcctgcacaccgtccgccccgctgatgacaagaatcgcataatccaacacctgaagcgtccgctccatctccgccgaaaaatccacatgccccggcgtatctaaaagcgtgaccgtctcctccggcagctttaataccgcctgcttggaaaaaatggtgattcctctctccttctcaagcgcaaaggtatccagaaacgcatccttgttgtccacacggcccgccctgcggatcattccgctctcatagagcagtgcctccgataaagttgtcttcccggcatctacatgtgccagaactgctgctgcaatattcgctttgtcactcacgttctccggttccttttcctacaaactgattcttctgtaacggttgatgcatgcaaaaatctcctgtgccctcggcattgccagcccgcacggcacatagctgctctccgtcaccgcggcaagtccgtgctcctccacatactgcatcaatagggaaacgctctcccttaaggtgcgttttccgttgaatacatggatctcggcatactttaaaaagtaggcgagcgccgcgagctgttccgtatccgccagctgctccacatagcgcacatcgatcgtatcgcggttgatggagatgccgtcgcgtcccattgtctttaacttcatgcgggcatcttccttgaatgcgcgatccggccgcaccgcacgctcaaacgtcggagccgcctgtttcggcggcttcacctccggcagcgggaatctgtccgcttcctccttcgcaaaagcggtgatctcctgcggtttgtagcggttcatctggacaatgcagtccgccacatgaaaataggagccggaacttcccgccactagaatcgtggagataccgtactgctcatacagctccctgatacggtcgataaacggcgtgatcggctcatcctcgcggtttaccaccctctgcatcagctcgtcgcggatcataaaattggttgcactcgtatcctcatcgatgaggaacgtctctgctcccgcctccatggcctccaccacattggcagcctgggaggtgcttccgctcgcatcctccgtgcgaaaggcactcgtatcctttccgttcggaagatcgttgatgaacatggaaatatccacctttttgatgcttcttccgtcctccgcgcggatcttcatcgccgtatcatcggtaatgacatactccctgccgtccccggcaatatggttgtacacgccaagctccagcgccttaagcagcgtggatttgccgtggtatccgccgccgacgatgagtgtgattcctttctttattcccatgccctgtatctttcccgcatgcggcagcgcaaagcttaccttcatggattccggcgccgtaaacttcacggcgtccttcatcggtctgccggacacgccggattcacgcggcaggatggatgcatccgccacgaatgccaccagcccctgctcctttaaatgatcccggatatactgctgatcctccgcgagatccgccgcacggtacaccgccttttcatccagcgccttataaaacaggctgtgtgatacacattccggaagaaacgtaaagaagattttctccagttctcttgcattgacggttctcccgttggcagggaatcccacctcaaagcgaagcaccagatccccctttgcctcatccatctggcatgcggtgcgctccaacacttcctgtcccgggcggctcaccgccagaagtccgctctttccggagccttttgccttgaaagacacgcgctcaagttcctgcccgaactgacgcagcagatagtcgcacactgccagcctgcggcatttcatccggtagagatccgccgggaacttcgctgcccctcccctgacatggacgctcaccttcgacggtgcggcaaacggatctccctgcacatggtcgatcgacaacacataattgccgaaatcgtagcttcctctcgtatccttgtaagccggataactcttatgatcaattctctgtaacagatttctaagttcattctgtgactgcatctttttattccttcttatattccttttatattctttcctgcgaaatcgtcagttgtcccgacgcagctccgacaacagctccgctcgtctcgttccaattaaaagctgtttgttgtatgtcagatagcgctcgcaggtatgctcggagagaaaccttgcggactccgacgtaatcgtgagctccgtgacaaacaccaccatctcctcaccgttctcgaacgcctgctccataaagtcaaacgcgtgctccaacgccgcgcccgctgcttcctcggtctgcaccagtacctcccgctgccggtcaaatcccacttttgccgcttcaaaacagcgctgtgccgaatcttttgtcacttcctgctgcgctgcttttaatttttccatcaaaagcttctcccgctttgcctcctcgcgggtgtaagcgtcatttgcaatctgccgcagcatctcctgctcccgctctgcgacaagcgtccggtaacattccgccggatctgcggctgtctccacctgtctgcggtactcttttaaaaaggcataccacgcatccgtcaatgcccgctcagacgctgccctgccgaaaaacaccgccagaccgtccagcagcagatgtaccaccgagagccgctcatcaaacgccgccgcatagatgcgcgcgtagatctccggtctgacgcagccgtccagaatctgcggaatgccgtagtcatcctgatatttgcggtagagatccagatacgccgccacatcctccgccacatcggcgtgatggatatattcccggataacctgctcgtccaccagaaaaccgagcttctcatagaccgccatcagattggagagatcctcccatcctcgcgccgtcacaaactgcatgccgtccacatccgcctccacgcggtaaaagttgccggggcgaagttccaggtagcttaagatcgctccgctgatgtgctgtgccctcgcatactccttccagaccctgtaatccgcctccacggtcatatagcgcacacggtcgagggttaccatatcaaaatcgcgcacggatttgttgtactccggcggattgcccgccgccacaatcacccatccctctggtatcttctggttgccgaaggtcttgcactgtaaaaactgcagcatcgtcggcgcaagcgtctcagacacacagttgatctcatcgataaacaggattccctcccgctgcccgctgtcacgaatcctgcggtatacactggcgatgatctcactcatcgtgtactccgtcacagagtaggtcttccccgcgaattcctcctcccggatgaacggcagtccgacggcgctctgtcttgtgtggtgcgtgatcgtgtatgccaccagcccgaccccgagttctctggcgatctgctccatgatctgtgtcttgccgatgcccggaggtcccatcagaagcaccggtctctgccggatctccggaatctcataatcccccgcctcatccttctttaagtatgcctccacggtatgtttgatctcattttttgcctgcctgatattcatatctgtgtccctttttatctcttaaaattcaaaaatgaccgcgggaatactccctgcagccacttcacatgcactgtcttttgccggttccctgcaattataaatattctatgttccgctacaggaaaagtcaataactttacccgcaaaaggtttcgttacctgttgcatttcaaaaacaaatgtggcataatacatattgttcgggcgaaagatttttgatatcgtctgaatcagaatccggggatatagctcagctgggagagcgacgcgttcgcaacgcgtaggtcaggggttcgagtccccctatctccatctttttttatgtttttaaagaaatgtccggcagcagacgctgccggacatttctgtctctcttatcttcaaacgggtctcttgtacggctttgatccgcctacatttccagcacgtcgtccgcaatgcccatcgtggacttccggtgtgacaccatcagaatcgttttgtccgcacattcctctttcaggctgcgcagaatcataccctcgtttaagctgtcaatgttgctggtcggttcatcgaggaacaggatgtctgcatcgtgcagaaaggcgcgcgcaattccgagacgctgccgctctcctcccgacagggagctccccagctccgcgatcttcgtctcataaccgtccggcagactcatgataagatcatggatggacgccgcccgcgccgcccgctccagctcctcctctgtggcatcctcttttgccaccttaaggttctccgccaccgtgtcatggaacaaaaacgtctcctgcgtcacataggagataccgccgcgcagcgccgctgtattgatctctccgatctttgttccgtcgtaggcaatcactccctcatccggctcgtagaaccgcatcagaagcttcaacaaggtcgattttccgcagccgctctttccgagaatgccgtgaatccgcttttccgtaaaatccgccgtaaaatcccgcagcacgtcgcgtccgtcttcttccccgctctcctgcgtgttcgcgtaggcaaaggacacatggtcgcagtgtatattctgaccgcacgtctcctcttttccggtcacttcctccacgagcggtttttcctccaggatatccagcacacggtttccgctcgccaaggtgtggtttaaattatttgacagcgccgagagtgctgctgtcggtccgaaggagcttgcgagcgcgatcaccgcaatcaccgccccgcttcccgggatgctgccgttttctgcaagcgttccacccacgagcgccgcaagcacacccgcaaagagaatcacaccgtcggtgatcacgcgctgtaagttctccccccgctttaatgcgccgttgaccgtctccagatgtccggtctgctccgccatcttagcgatgcgtgcctcctgctgtccgtactgcagcgtctcctcaaggccgtaaaggttgtccagcacacaggtattcaaagcgccgaatgcctcccggtattccttgccgccggcagctccgatccgtccgttgacaaccggaatcacggctccgacaagcacatagaagaaaagtgccagcactccgaaaacgggatgtatccttcctaagaagatcgtcataaccaccgatgtgatgaccgcgattgcgatcggcgagatcgtgtgtgcataaaacacctcgagaagttcgatatcgctggtgataatcgagatcaggttgccctttttcgcgccgtccaacttggccggtgccagtctgcgcagggaatcaaacacctgatgccggatgcgcgctaaaagtttaaacgcgatataatgattgctcgcctgctctgcgtaacgcaggattccgcgcgccaccgcgaagcagaccagcagcgtaaagatcacggaaagcctcattccactgtatacaccggtcacggtaagcagtgcatagcctccgaggattgttaaaaacgtcgccatcagattgcccgcacagcccatcagaatcgccagacacatgatgccaagcagcggctttatcatcccgatcagcccgcacatgacggcaaatccgcttctctgctttttattttgattgtctttgttctgcttcattacaccgtcacctccttctgctgtgtgcccgcataggattccagttcctgctgcgcctcatacagcctgcagtaatatccctgccgctgcatcagctcctgatgcgtgccgtgctctgcgatcccttccgtccccgcctgcagcacgaagatctcatccgccactgtgacattggcaaggcggtgtgagatcagaagcaccgtcttttcacgggcaagcccgcggacgacttccataatccggttctcactctccacgtcaatgttggatgtcgcctcgtcaaaaatatagatatcgctgtcatgcagcagcgcccgcgccagcaccagacgctgcttctgcccgccggaaaggtttgccgcgcgctcctcaagctgcatggaaagtccgcctttctcccggatcgtctgaagcagatccactctcaaaagcacgtcctccatctctttctgcgtggcatctgcctttcccatccgaaggttgtcctccacggttcccgcaaagagatagctgtcatggcgcactcttgtcaccttccggtaaagtgcctccgccgtaagctctgtgaccggcactccaccgatcgtaacactgccgccctcttttggacggttttcccccatcacaagcgatgcgaccgtactttttccacaacccgattcaccgaccagcgcgacaaaactcccgcccggcacggagaaatccacatcgcgcagcaccggggcatccagtgtgtaagcaaagtccacatgggaaaaacagatctcattgccctgcgttttctgcacagtaccatgctgtggcaccgacgtatccaaaaaccggaaaatcttgtccgcagcggcatttccattcatcgcaatatgaaagaaggagccgagcagacgcagcggaaggaaaaactccgccgagatcataatgataaaaaagcactccgcaaacgtgaccgctcccgcccggtattcaagcacgcttaagatgatgccgagcgccgctccgccgtaggcaaccagatccatcacgctgatcgaattcaactgcatgatcagtacacgcatggtcactttgcggaacttttccgcctcctcatccatcttcttcgcatagcgcccgtccgcctgataaatctttaacgtgacaagtccctgcagattttccagaaaggaatcgccgagttccgtgtaggttccccagtattttgccagcagcttcttggcaaacttctgtaccgccacaatcgacaccggaatgagcggtacgcagagcagcagcactgccgccaccttgatactcatggtgccaacaatcacaaacaaggtcagcggcgccagcatgctgtaaaaaaactgcggcacatattttccgaagtagatctcaagctgatccactccctccgtcgcgatctgcaccgcctccgaggtcgccaccgcctcccggtaagccgccccgaactccatcatcttctcatagatccggtcgcgcagtctgcgcttcacctgcgtggacgcaagataggacatccggtttgccgcactcgtcgccgcgatccgcacaaaaagcgccgccgcaaatacgataagcagcactccgtcggacggggaggtcgtgaggctctccccttttacaattccggatattctcccgacatacgctgccagcacatacataagcgccacattggcaagaagcgccgcccactgcatgataaccattcccgccacgtatttccggttatcggaaaattcctttaacagtcttttatgaaacatgtttctctcccttttcccttgtactgatctctttctgctttttcttattccgaagtgtgatatgcacatgccggatggcaagcagcggatgcacaaacaacatccttggtcccgcatacttcatcacttcacggattttctcctgcatctccttcgaataacagtgcaccttacaggcactgcagaacgtcttcgtctccataaacgggcatttttccgtgcgaagatcggcgtacgcctgcagctggcggcacgcctcgcagagttctccccgcttcgtcccgtgcactccgcggcagtagatgccgatcatgcaatccacggtctctttctcccccgcacgcttctgttctatctcctgcgccgtcattttctccattccctagtcctcacttctctcctttaaaatctgttccattatcccggcgcactttggttcaaaccttgtattttcccgctcctttatcttgcctctcaccatttccgtactctcgccccagcgtagatggcggtccgcatagtccgccaccgcgaggatctgcgcgagcaccggtatctcattgccgcactttcccgccagataaccgctgccatcataattctcccgatgatagtacacggtctccgcgattgtatccgccacctgcagttcgctgatcatatcatagcccatcttcacataagtctggaacacaccgtactcctcatccgtcaggttccgtctctggatcagttcgtctggaatgccgatcattccaatctcgtgcagaagacctgcctgataagccccggacaccatatcctccggaagatccagtctttttgcaatctcttttgcgtattccgccacctgcctgcagtgttcctcctcaccgggaatcttcgcgcccagcgcgcggcacatcgcattcatcacacgcatggacattccccacagcttttccttttcctcgcgcacgcgccgctccagccgttcctgccgtctctgcttctccacccagtaatgctggatggagtacattaacagatatgccatgaacacaaagcacacatacagataaggaaaacgcagtgccacattctccccgtagatatcttccgcggaagcattcaggtcgaaccggaagcacaaaatcatcgccgcaagatagaacagattgatgacaaaactgttgcggattcctaagataaatacaattccgcaggaaaacagcatcgggaacaatacactgaagtacccaatgctcgcgtggtaatacacataaaaaatcggaatgctgagcaacgtgaatgtcaccacatcgatccatctgcggtaatgcctccgacagaccgcaatattgccaaaaagcagcgccaccatgatccccaacgcaatcagataggatgccctgacaccgtaaaatatgccgttcaaaatactgattgcccagataaatccgaaaacaattttcatccagagtgccaattccctgtcctcataaggagcattgaccgtatcccagaagttctctcttattctctttgcttttgtctctgcgttcttcatcctttataccgtaatcctgccttcctcgatcaatgcaacaaccgcctgcgccactccggcgtcaaactgtttcccggctccctttcggaattcgccgataatgtaatccctgtcacagtgctttctgtaacagcgattggaattcatcgcgtctaacgcatccgccgcactgataatgcggaccatctccggaagctcctccccgtgcatgccataaggatagccgcttccgtcgtaccgctcgtgatggtatgtcgcgcccagatccgcctgcggcaaaaactccagaccggataagatctctctgccccagaccgtatgttttttcatcacctcgtactcttcatccgtcagccgttccggcttatttaaaacggcgtccggcaccgcaatcttgccgatgtcatgaagcagaccgctgcggtagatcagttccagttcctcccctgatgcgcagcctccccgcatataatccgcgatcagcctggaatactccgccacacgctgggagtgttctctcgtgtaacggtccttggcatcgatcagctggctgatcgccgtgactgagtgaatcatcagattcttcgtgcccgcaaccgcctcctgcacctcattctccagattttcctcattctggcgctgccggatctgataatttttgtaaaaaatatccatcgccacatccatcaggcagaatccccagtaaaaaatcggatagaacacccgataatccctcggataatcataccttaatatatccgcaagcggcgtccagaaaaaagtcataatcatcagaccaaatccgatgcacaccggcgccccaaatggcattccaagcggaaccagcgtgataaccggcagcagcagataccacagcagggaaaagccgtcattcgcacccgcgtacagaatggcagccgccagcagcaggaacaaaaagaccgcaatccgacacacgagaaccaccttctggaaccgccggattacaaacaccgccgtcacgctcacaattcccacgaccagtgtcacaattccgatgacatactttcccagccggaaattctcaatgtcaatcagaaacaacaccaccgcaaagatcagcatgaccccctgcagtgccccaacatccatgccggttgtcttctcataccggtacactctttttatcgtatctaccgctccccgaaacagcttcatttgtctcccgctccttttatccgccgaattagtttatcctaactattttcttcttgtcaagcatcatttttcatatcccttattctaccaaatcccacttcacatgtacagaggagcgtttttatggggctgccgcaataagcatattacgctttgctctgataagtaatattattagaaacagatatttaaaagttccagataaacatgcggcaacaaattctgaacgcaaaatccggtatttctaaccatgccgcagatgacatctgtgatgatccatgtctttccaagtttggagcactccacggactgtgtccacaagccggcagacaatttgtaggacttttgtgtgtgtcccttatggcacctctgaacaaaacataaccgcgcgaagccgctgtctgagtcggcatctgccatattttcaatagcagatgccggcgagttcggttcgcgcggttttatattgtctgtgaagaggtgccattagggacaccagaaagtccgcccattgtctgtggcttgtcggacacactccgggagtgttcaaacgtggcaaagacacggaatgggatgccaactgcggcatggaagaaatacatgaattttgcttcaaagaatttgccgtcgcatgtttattctggaacttttttgtgctctactattctaataatattacttatcaccccaaagaggtctatgcttatcgcggcagccccataaaaaaactccggcagactcttacgaatccgccggagctactcttttttcagattttacagttctttctcgaagaatgccttcatcgctgcaacagcggcatcctcatccgcgccgtccacgttgacggtcactgtctcgccctgctttacgccaagcgccatcactgccatcactctggtagcgtccacttccttctcacccttcttgatggtgatcttgctggtgaagttctttgcctcttttaccagaagacctgcaggtcttgcgtgaattccaagttcgtcttttacggtgtaatcaaatgttttcatgttttccatttcctttcttttcttaatttatgtggcttttatttactccattccgacaacgcgctcgcgcaccggaagtaccatcgcaggtgatacggacaattcgtcgattcccatcgcaacgaactgttccgtcaatgttgtatctgcgccgagttccccgcagattcctgcccagataccctccttatgcgcactgtcgatgaccatctgaatcatcttaagcactgccggatggtgggaatcatagaacatatcaagctttgcattctgcctgtcgattgccagtgtatactgtgtcagatcgttggttccgatactgaaaaagtccacttcctttgccagttcatcggcaatgatgactgccgccggtgtctcgatcataataccgaactccaccttgccgtaagggatcttctgtgcatcaagttctgcacggatctccgccatgatctccttgaccttctgtacctcccagacggaaataatcatcggcaccatgatggcaatgttgccgaacgcactcgcacggtacagcgcgcgaagctgtgtcttaaaaatctccggacgatccaggcagatgcgcactgcgcggtagccgagcgccgggttatcctctttgtccagattaaagtagtcgatctttttatctgcaccaatgtccaacgtacggatgataacttttctgccacccatcatctccgcaacgctcttgtatgcggaaaactgctcctcctccgtcggataatggtcattctgcagatataagaattcactgcggaacagaccgattccctccgcatcgttcattaacgccgcgccaacgtcgccgatgccgccgatattcgcgtacagcttaatggatttgccggattttgttgcggtcggcttgcccttcaatgccgataacagttctttgcgtttgctctcgtcttctttcttcttctgatactccgccaggacgctctcctccggctcaatgatgattttgcctgccatgccgtccacaatcgccattttgccgtccatgccgtccgctaccggcgtacataccagtgcaggaatgttcattgtgcgggcaaggattgcggtgtgggaattcgtcgatccttctctcgtcacaaacgccagcaccttggaacggtcaagctggatcgtctcactcggtgccagatcgtccgccagaatgatcgcctgctccatctccatggactgcgcgccgctgccgtgatgcaacacggcgatcaggcgctcggaaatatccttgacatccgccgaacgcgccttcatgtactcgtcatccatgccggcgaacatcgctgcaaaattgtcccctgtcgtagcaacggcaaactctgcattgacctcctgtgtcgtgataatgttgcggatggaatcgcagtaatcctcatcgtccagcatcatctgatgtacctcgaagatcgctgcattgtcctctccgacttcctttaccgctttgtcatagagtgctcccagctcctccatcgcgactttttttgcctcctcaaagcgtatacactcagctgcggtatcatcaacatgtgatcttctcaccgcgctgctcttcttggcaaactcccggatcgggccgattgcgattccgctaaaagcggtttttccctcgatacaaatcatatgcattctcctttcattcttcgcttattcatctaatccacgcagtgtggtctctacctgttccagtatgtgtgcggcatttcccgcggcatagtcccccggcgcaatggcaagcaccggcagatttccgcactccgccgcaatcttttccctgcggtatgcaatctgcggtcccagaaggatcacatcataccccgtgcagcattccctgtaggcatgtaccccgacggcctttacttccagcggaatctgttccttttttgcatattttatcagttccccgcgcagaatgtcggtcgacattcccgcgctgcagacaagtaatatcttcatcggctgcctccttttgcctcctcaagcgcacggtagacatccacgatctcctccgccatttcctgcgccagcgtcgccatcatgaaatggtcctgcgcgtgtgtcatcagcagtcctgcgtctgtctgctgtccgcccgcctcccgtaccagaagatcggtgtgcaccttatgtgcttccgtggcatagcgttccgcctcgtccaactgctccgcggctcccgcaaaatcaaagtccttagctctatgaatcgctgcgaatgcacagcttttcgccgcacctgccttcgcaatgatctccatcgctgcttctctttgctgttctgtctcatcgatttcatccatcctgctcacctccgtgaccgactctgtctcattcctgaatctgcatcagtatggaaatgatgttcgccatctcgtcatcggaaaaaatcatgtggaatttccgctcgaccggcgctacatattttcgcagatcccggtataccccgtgatacttctgcacaatttcctcgcggtgcggattctctatggaaacgccccttcccgcaatccggttgactgcgcaggcaatgtgcatcacaagtcctgtcttggtatctaacgacatcggatattttccctcaatctgctccgccagttccatgagcgcctcctttaagcggccgatgtccacatattccagatgatcgcccagacagcggaacatttcatcaaaatcaacctccgccttttccatgcgctgtgtgcgcaaaagctccggcagacgctccaccggcaccgccagcacatccgccgctgacagaaacggaatcgccagaatgtccggatcatacgttccgataatacacaggatcactgctccctgcataagttccagcagtttttcccgcagcaggttccggtccgataaggataaggcaatcacctccgcgtccgtgcaggctttatgctggatgagatactgcttcatctgcagcgcaacaccctcacttgtggtgcagagcgtaacgattactttttttggggaatgccgcagcgccccgagcgactctgccgccatccggtaaacccggtccaccccatcggcgattgccgcccccttcgaccactccattccgaatcttgtgaccggaagcgctaccgcgcggagctgtgttcctgtctcgcaggaaattgtatacaacatctgctgcaataccttctggtcatacacggcaaggactcccgcccctctatcgatcgcgagcagtttttgccgcagcaactcgtaggtctgttcatccttctgttcgtaaggaatgtcaacggcatacacgtttccgcggtgaagctgctcctcgatggtatctgagagtgcccgcgcgactccctgtccgtaaaagacaaataaaagtaccggcgacggttcgtccgtccggatctgtggctcgctgacctgcgtctcctcggcaggcggcatttccggtgcaagtaccgtcacgcccccttcctgatagaaatagcgcatctgcggttttaccagcgcatccaccgcctccttgtccgcgcggtagtttaagaatcccttgcgcacagacggatcaaagtcgctgatgtagaggtgaagttctcccccgtgatccatgtagtcccgcagataagcattcatgcaggctttccggatctgtgtctttaaggtcagtatctccttttcacaagggaacagcatcaggcaggtgagcacctcggactccagcgtgatcgtgcgcttcgttctgcatgcctccgccaccagaaaatgttccagcagcttccgccgctctggaagcggacgctccgtaagggacgggagccggatctccgccagcacgtggtcttccagcatggaaatcacatccagcgccttgtcgtcgcaggatagaaaaatcatcggcagttcccgcgcatcctccgcctccacaaaacagcggagcagcttacgtctgacgttcaccgacaggaactgtaccttatgtaaaaacaggattcccgtggctgcctccgcgagcattcctccctgcacgccgtctccgagcagttctgcgatcgttgccgtatcgtccgctccgaaatccatgcagtcacacattacaaacggcgcctgttccgcaaccagtccctgctgtacggcagctttgtgcatcacttccgccatgtattttctgccgcttccctctcttccgatcagaagaacattcagtccgcggtgcggatacaaaagtgccgccctggcaagctgaacggcgtattttaaactgccgtcatatcccaccagttcccggaacgctccctcctcatccgcaaacgcttccgtcagcgaatataagaccggccggctgctgctcttttttaccctgtcttcccggaggagttcgcccagtgcagtgctgacgttggtgcgctgcattccgagtgcctctgcgatctcattagtagagatcccgtgattggcattcacggagctgtggagttttacaaattcgtatatctgctctctgtttcccttcatatggttcctcataagaaatcgctgatctcttcgatacgcttactatatgttttttctttctgactgtcaatttcacatagtgtataaattttgtatccttcatctatactcattttcatacaaaatgctttctttttcaactctctttttgtctgttttttccaataatccgcttcttttcttcctgtcgcttctttctccgcttatttagtgtatatgtttctgctgatcatatacacttagtgtacaagttttttctttttttacatttttaaagattttgaaaaaaagaacccgtgagaacatctccgcaattcagatatgttctcacgggttcttatgataatttcaaggttatattttgatgtttcttgaaggaaaaatggcaccgtttctagtacagattgcagcgcccgcgctcctcgcgctccatatcacgcacatactgcgcctgatattccatcgtgatctcacgaagttccttgattccctcaatataaggcagatacatatcatacccgtccatggcatcatcgcatcctaactcactgtatcccagggaatcttttacgatctgctcccgctgttctcttgttgtatttttgatcagatattcttccatgtttttctccttattctaaaaagtcagacgcatttcataccacacagcgcctccgtgttccgatccggataccccctcattccggtagccgaactgcccgtaaaacgaaagcagcctctccttacaggtcagcaccagtccctttttcccctgtgactttgtatccgcaattaccctgcgcatcagcgctgccgcatatccctttccctgctctgcggggtccgtcgccacaccaaagatcatctgccacgcaccatccttgctgtgcatatcggcatgttcatacatcgcgtcggtcagatgctcctcgtcggttgccatgccgttaatcatggataccagtttttcatcctcgtagagcagccagaaatgatcaggaaaacttgccagccgatcgaaaaatgccgctctccccgccgcttccgccgcaggaaagcactttgcttccagctctgtaaccgcctttaagtcctccattgccgcatgtcttatgatcatcttctcttcctccctgcgccgttctcttatcagaacacattataagcgccttcttcgcccagtgcaagtaaagccttttcactttacgtgaaatatccgcaaaaataaggctgtcgcatgtagcagatgttatccctttcagcgataagtgatattacaggaagcacatgatacagatttcggctggaactgcagatggaacattcgttgaaaaaaatgggtgtatttcttccagccggatgactgcatctgattccgtgtttcttccacgtttggacaatccgacgggtgcatgtccgacacacccgagacaatgggcggactttctggcagcactaactgtgctccctcatagacattattaaaccgcgcgaacagaactcgctgctatcagctattgaaattagggcagatagcagctcaaacatctgcttcgcgcggttatgttatattacgggagcacaggtaagtgctgcacaaaagtcctacaaattgtctctggggtgcggacatgcaccctaggattgctccaaacttggaaagacacggatcatcgcagatgcagtcaccggctggttagaaataccgcattttttgaacagaatgttccgtaggtattccaaccgaaatcgtagtggcatacttctcataatatcacttatcgctgaaagccaacgattcctctaatgcgacagccgcatttttgcagaattctatttcacgtaaacgggaaaagtgctttcacagccggatacagcttccggaattcctgatagcgcgcctcatacttctccaccagcaccggatccggctcaacggtgtcaacaacatgcaccagcttctcacatgccgcctgtacactctcatattccccgcagcccactgccgcaaggatcgctccgccatatcccggtccctcctcgctctctatgagatcaagcttaaggtttaaaacagccgcaaggatcttcttccacagcgggctctttgcaccgccgccgcagatcttggagcgttcgatccggatgcccagactgcgcgccacctcgagggaatccctgagaccgaacgctacgccttctaacaccgcctgcgtcatatcttcccgtgtggtgtccatcgacattccaaggaacatggctctcgcatccgggtcgttgtgcggagagcgctcccccatcagataaggcaggaaaaatacccggttttctcccagatttttaatcttttcctgctcccgcgcatactccgtcgtctttaaaatctcatccatccaccacttgttgcaggatgccgccgagagcatacaccccatcagatgataaccgccatccgcgtgatcaaaggaatgcagggcattgtgtgcgtccacaccaaacttttcactggagataaagagcgtgccgctcgttccaagcgacaggttgcatctcccctcaccgaccgtcccggtgccgacggctgccgccgcattatcgcccgctcccgcaatgatctttacttcaggagaaagtcccagttcttccgcgatctctggctttaaggttcccaccacctcatagctctcataaagcttcggaagctgctctctttccacatggcagatctcaagcatctgctccgaccatgcccggtgctccacatcaaggagcagcataccggaggcgtccgaataatcggtgcagaacgttccggacaggcggtatgcgagataatctttcggtagcatgatctttttcacccgtttccacagatctggctcatgcttttgcatccagagaatctttggcgccgtaaatccggcgaaggcaatattcgcggtatatcccgacagtgtttcctttccgatcacctgatttaagtaatcggtctcttctgccgtgcgcccgtcgttccagaggatcgccggacgaatcacttcatcccgctcatccaatgtcaccagaccatgcatctgccccccgaagctgatccccgccacccggcttttatcacattccgccagaagttcttttaagccgtcgatcgactgttcataccagtctgccggattctgttccgaccagcccggatgtggaaatgaaagatcgtaggtgcgcgatgcaattttttttattttaccatcggcatccatcagcagcaattttactgctgatgtgccaagatcaattcctatatataacatactctccccttttcttatcattgcaagacttcgctatgcactgcaagacttcgctatgcactgcaagacttcgctatgcactgcaagacttttctatgcaaacggattctccgtcggatagcgcacgcctgccggctgattgtagccgatctcctccaccggcacaccgatatacttaaatacttcgtacagcgccttgccgtaatgtccgaatgccaccgcgccgtggtgcgggaaattcttctcaatcagcacatggcggtaaaatcttcccatctccgggatggcgaaaacaccgatcgatccaaaagatcttgtcgccaccggaagcacctccccatgtgcgatataagcgcggagctcgcagtctgcggtgctctgcagacggaaaaacgtaatgtcccccggcatgatgtccccctcaagggttccgtttgtcacctcgaccggaaggcttctcgccatgatcttctgattgcgcatctcacagaacgcaagctttccggaagtggtatttccacagtggaatcccataaaggtgtcctttaacgtatatggatattttccctcgatctcttcctcatacatatctgccggcaccgagttattgatgtcaagcagtgtcacggcatcttcgctcaccacggtgccgatgaactcgcttaaacagccgtaaatatccacctcgcaggacaccggaattccctgtccggtcagacggctgttgacgtaacacgggacaaaaccgaactgtgtctggaatgccggccagcacttgcccgcaatcgccacatacttgcggtagcccttgtgatcgcgcacccagtcttttaaggtcagttcatactgcgccagctttgcaagcacttccggctttttattcccggctccaagctccgcctccatctctgccacaaccgccgggattctctcatccccgtcatgtttatggaacgcctcgaataaatcaagctctgaattttcctcaatctccacacccagattgtaaagctgctttatcggtgcgttgcaggcaaggaaatttaacggtcttggtccgaagcttatgatctttaaattggaaagcgcaactaccgcgcgggcgatcggctcaaattcatgaatcatgtccgcacattcctctgccgttccaaccggatactccggaatgtatgccctgatattgcgaagctttaagttatagctggcatttaacattccacagtaagcatcccctctgccatccagcagactgtccccggattcttccgccgcagcaataaacattttcggtccgtcaaaatgctttgccagcagtgtctcggcgatctccggtccaaaattgccgaggtatacgaccagtgcatcacacccggccgccttcacatcctccagtgcctgcaccatatgtatttcgctctccacgatgcagatcggacattcatagatgtgatcctttccgtactttttcgtgtaagcgtccattaacgcctttctccggttcaccgacaggctctccgggaagcagtctctgctgactgccacaactccgatcttaatctccggcatattttctttgttcataaaaatctcctttccgtttcaaaaatagaaaccttcctgctccgttttccctgtatctttcttacacctcaatattgacccccaaaagtccgttaaaagcaccacggattcctgcttcctcatgtgcgatcagccacttgttcttcgcagtcataagcgcatcctctccgcttttgggcaaggcaaaatcaatctccgtattcgtccctttcggaagaatcacaatacatttaaatccttcctccccgtcattgcacggcgcatagtgaagtgtcgttccatacatctcaacaaccgttcccgccgggacaaaaaatgcttccaccctggatgtgtcataagtaaacgcatcggtcacatccggcagccatcctaacagcagcaccatattggttaccgcaatattgatctccgaattgcggtgatactccaacgcatttaatctgtgattgctgccgttacaataaccgatctgaatcggaagtccgccgtagatccgtctggcaaactctcccgcctccggcagcacctccagttcctccatggatggcacataaatgacatcctccggcagcggcgtgtgttccatctcgcggatcagtctcgtgcagtcaaagccgctccagactttcccatacctgcggaacttttcgtctttaattgaataaatctccatgattcccccctgtttgtgctcctttccataagtgtaccttataagcagagtataacaggagacagtcatggagactacctgtttcttgtctttccaatgtcacttttttgtctttttatctaatttatttatcagtgaaataattcttcccgcacagagacggattttcttttccgacagccttccgtctgcatacgcctgccggatatccgcatcatctttctcacttcccggcataatcagatcatttccggcttcgatacacttccatggaatactgccgtcttccggcgctgttgtactccagtccgacatgagtacaccgtcaaatccccactcttctctggcaattacagtgcatagcgctctgctgtttgccgcgtgaactccattgacccggttgtaggatgtcatgattgcaaccggtgcgctttctttgactgcaatctcaaatcccctaagatagatctcccttagggctctctctgaaatatgcacatcgacccccatacggttgtcttcctgattgttgcatgcaaaatgcttgatcacagctccacaggttccctcctcctgtacacctcggacaaccgcagcagccatcttgcctgagagaaatggatcttccgaatagtattcaaaattccgcccgcacagcggatttctctggatattcattcccggtgccagccacagatcaatatggaattctttcatttcatgtgataccgctcttccgaaagactgcagcagttcctcattccaggtctgcgccattgccgttccgaccggaaacgccgtacagaactgatagtaggtcttggcattctcatgcttttgcatcggctccagatagccattttccagtgctcccagtacactttttccatagactttccccgaatctgcgtctacctcatacgactgatgcagccggattcctgccggtccgtccgccatgattaacgcccttattccatagggctgttccagcgcatgtgttgtctctcccgccgatcccgggacacggattcccgccgcgccgagtgtactgctgttttgttccacatggccatataagagcggaatcagttcctctgccggtatttttccggtcagatgcactttttgctcttcagcggcagaaagctttcctgcatcactctctgctgcctccagccggcatgtgtgctctgtgatcgtccgttcgtacacatcaaattcccatgcctgttctaacttttgtgaatcggcaccgatccatatgccatacgttccgtcttccagataccaggcactctgttcttccgaaaaacttgcaagcatgttttttggtattttaatctccagctgctgtatttcccccggcagcagacattttgttttggcgaatcccaccagccgctttttttctttttccattccggtctgcgggaatgtcgcatagacctgcactgtctccttcccggcataggttccacccgtattctgcacagacactgcaagttccagggaattcgtttcctcgcgtacagaccgctggcggattaggaatgatgtgtaggaaagtccgtacccgaacggaaataataccggcagattttcccggtcaaaatgacggtatccaacgaaaatttcctcccggtattcttccttttccagatctccgttcctgtatccataagtatccgctgacggataatccccgtaatgtctcgcccatgttgccgtaagttttccgcttggaaccgcctttccaaacaggatgtccgccaccgcataaccacctgcctgtcccggctgggaaatatttaacacagcccgtatattttttgcctgctctaaaatatctgtcagttctaccggaccaccggtattcagcaggagcactaccggaatctttttctcattcaaaaataacaggtcttcctgttccctgcggcttaattcatagtcgccgcgctcttttctgcggtcacttccctcacctgaaatgcggctcagcacataaactgccacccctgccccggcaatgtcctgttctgtaaccgctcttccctccgggaaacagaacggatgattggaatatgcgtcaaacggattctcaacccgttttgtttcttcgagaaccagttttttccattcctctctcgcctgctcataccgcttttcatagtcgcacagccacgcttcacttgtgatcattgcgcccgcttccagcagtccctgatagacagaaattgtcttccggttgttgacatccccggagccgattccaccttttaccgtcttttttgccccgcttccaaacagcgccataggaacatccaaaggcagcggcagaagcgattcattttttaataaaaccattgcctcttctgccacttttcttgccagaacatcatgcacctgctcccggatggacgttctttcctctatggttccactatatctccattctcttttttccatattctctgcttttcccttcaaaatgacagaaagaaccatacagaattttcttccatatgattctctgtccagatcgtgtttactctttcactccaccaagtgtcacaccggcgataatatattttgataataaaagatatactacaatgatcggcacaatcgccaccgtaatcatcatgtaaacttttcccatgtcaaagttcatatagtctgctccacgcaatgtcgcaattaagatcggcactgtcattttgctcttggtctgaagaatcagtgccggaacaaagtagttattccaggaaccgacaaaagtgaaaatcgcctgtaccgcgagcgccggcttcataatcggcagcacaatacagttaaacgtcctgaattcgcctgagccgtcgattcttgccgcctccactaaggacaggggcagtgatgactgcaggtagctgtacataaaatagaataccgcaggcgacgcgatgcttggaataatgagcggataccaggtatcatacaaccccattttcgtgatcagccgcaaaaatcccattgccgttacctgagtcggcatgaccaaaattgccatgataaaggtaaatgctatctttctggtcttaaattcataagcatacagaccatatgccgtcaacgcggaaaagtaagtacacaaacccgcacaggcagtcgagatacagatactgtttataattccgcgaaacatcgggaagcttccgtcatttgccacattctttaaattttccagcagatgggtgcccggcaatgccgaaaaccccttttgcagctccgcatgagaacgggttgcattgataatcagaatatagaagaagaacagacacataaatgacagtacaatcaacacaatatgcgccagaacactccgcaaactgtttcctgattttgatttcatgttttatctcctccttcttctttcttctctggcagcttttttcgccgctgccttcgatccgtccggatcattatcatttgtcatcttatacacgataaaacataagatcgcactgatgatgaacagataaacagataacgctcctgccataccatagttcttgctctttaaatgattatttaagaacatgatcagtgtcatggatgtccggtccggatttccctgaccgttcgttaagatctgtggcacatcaaacatctgcaatccgccgataatcgaggtaatcagtgtatatgcaagaatcggccggatcatcggaagcgtaatatagaaaaatctctgcagactgttgcacccatcgatctcgcaggcctcaaatacctccacactgattcccatgattgctgccatcagcataatcgtcgtattgccaaaccacatcaggaaattcataagtccaatcagggaacgcgtgccaaaaacagatcccataaaatcaatcgggctattgatccatcccagagacatcagaatggaattgaccggtccactcgtggaaaacagtgtaaaaaataaaagtgcaaatgcagatgccatgatcagattgggcagataaatgacaaccttaaaaaattgtttgtgatgtatctttaatctggcatccgtaaaccagctcgcaagaacaagtgcgatcacaatctgcgggataaaaccgatcagccacagaatcagcgtgttttttccatatgccatcatatcggatttcaacagactgatataatttgccattccaacgaaattaggtccgacctccttaattccggaacggtaatattcataaaaactgtatctgacggtatctgccaacggaatcagtgaaaaaataaaatagataataaaaaacggaagaataaatatctgtccccattttccatagctgatactttttttcttttttttcattcctttgccctctctgccataatagttctgcggagcaaaattgctccgcagtcatggtcttattccggccactgaacttctgtgatatccggataacgctctttgattgctgtctcaaagtttgcctttgccttatcaaaatctacatttccctgcagataatcgctgaacgaattctgaatcagttccacgcatccctgatcgtatgcagataacggagcaatcttgatattctcagctaccggtgcaaagtagacaaacggattctgtccgccaaggaattctgacgagaagtctgcatcatcctttgctgcctctgccattccggacttcgtattcgtgaaatcagagtaatcctgtgaaatctttaacaggttgtcctgattgcttgtcattgcaagaataatatccttcgcatattttacattatctgttcctgttgccgcatggatgtaggaaccaccccagttatattcctgtggcgggttcgtaactgcccagttgccggcctctccatcccagttcggattcagcacaaagtcaatgccccatgccggaagcagaaatgcaaaaaccttggactgggagcccatggacttattccagtcatcattccactgacccttgatgttgctgtccagataaccggcatccagccattccttagaatcattcacccagttaatgattttctgatctactttgacggtggtatctcccggctgaacccaggattcatcaatactgttgccgtacagacggaacgtatccgcataggatgcaaaggtataatatccttttgcctttaactctgccgcggtgtccttgatggttgcccagtccttcaccttctcgccgactgcctcaggatcatctgttccgaatacatcctttgcaatatcgcggcggtatactaaaagtcccggacagcactgccaggtagatcctctctgcacaccgtcagaatcagaagccgtagttctcgtaaaatcatactgatccgccagatccgtctcaggatcaattccaagatctgtcagaggcatggcaacatccgcatccttatcggtatatttaaatacataatccgtctcggacaggaagatatctaccttgtcatctgccgcagcatctgcctgattcataagcgcttcatccagcttctgctgataaacaccatcctgattcggattgatcacccagtgaatctctgttccatccttcagcgttgttaccgttccgtctgaggaagtagattccacctccggatatactgcctcaagacgtgtacggaactcatcgttccaggaatagatgttaattacctttccctcaccactgaaatctttctcgtccgactctgtgcctgcagccgctgcactctccttgccgctgtctgctccggcattggcactgtctgtggcactgcttccacatcctgcaagtaaagtagcccccatagccactgtcagcattaagctgataacccgctgtttcatacttcaattcctccctgtattttagtttttcaacgtcagaccctttccctataatgtctgccgtcttcttgattacagatagaattgtactgaattttatgactggaatatactaaatcaattgtaaaaatatcagattcatgtcataataaccatattcttattttacggaggaaacagccaatggccttttcagaagaatggtacgagaccgaattaaaaagcagtgaacttgagacccttcaccggccgccaaccgtggaatattccttttatacggcagtcaaaacaggggatatggaaactgttgtcgccaactgcaaagaggatgcatttatccatctggagggaaccggtgtgctctcgcgcaatgcgcttaccaacataaaatatcattttgtagtcactgccgccatgcttacacgctactgcattgacggcggtttggagccggaacaggcctatcgtctgagcgacttttacattctgaaaatggacacctgcacaaccgtccggcagattgcggatcttcaccatgaaatggctaaagactttaccggcaagatggttcttcagaaaaaaagttccatcttatccaagccggtcgtacagtgtgtggattatatttacagtcatatcaaagaacgcattaccgtcgccgtgctggcagaatataccggattatccgagagctatctctcccgggtattcaagcagaacctcggcatttccatcagtgactatatccgcgagaaaaaaatagaaaaggcaacgcatctcctgcgctactctgacaagtccatcatagacattgccaattacctttccttttcttcgcagagccactttatccagacgttcgaggactttaccggtatgactcccaaaaaataccgcaataaatattacaaatccatgtggtaactccccgcgaagaagccaccaccggagacaggcacggttcccctttggcggtaagcaatattgcagaaagtatatgtcctgcgattcccagagaaagacagccggagcattcggtacaaaaaatacggcatttctaaccagccgtgatttgcagctgcgatgatccgtgtctttccaagtttggagcactccggcggggcatgtccgcactccgcgagacaatttgtaggacttttgtgcagcacttacctgtgctcccgaaaaaaacataaccgcgcgaagccgatgtctgagctgctatctgccctgatttcaatagctgatagcagcgagtttcggttcgcgcggtttaatattgtctatgagggagcacagttagtgctgccagaaagtccgcccattgtctccggtgtgtcggacatgtgcccgccagtgtgtccaaacgtggaagagacacggaatcagctgcaaagctctggctggaagaaatacgcgcattttttcccgacgaatgctccagctgcttttctccaggaatctggcatgctgtgcttcctgcaatattgtttacccccgaagaaccgtatatgcctcctgtgaagaccactatctgcttcctatcttccaaacaggatttttatgacatgctctttttctgcatccagctgtttgatccattcctttttgatccgcacggcatatgctgcccccgcttccggttccagttgcttttcatcgcagaggacactttttatccactcttttttacactcgcacttttccggatttgagaaccggatgtcgaatttctttcccgcaaaaatcagctttacttctgcatttccctgcgcatcaaactgttccggcatgaatgccggcgcaattaccagatctcccatgaccccctttacgccgaatacttccgtaaccatcgtaaggagataccagcttgccgcacccgtcaggtatgcatacatgcctcttcctgacagatcataatattccggcagtcccggatacatcctgctgttgtcaaaattcattgccgcgttaagaagagcctgcagggctttattaccctcccgcgcaaatcctctccggtacagtgcattggcgtacatgacagccatatgggaaaatactgctccgttttccttctccccgtaagcaaatccaaacattcttcccagatccattttttcttcaccaaaatccgtattcagacggtagccgcccgctttctcatcatacagatatttatcggcactctggcagattttgcggatctgatccggtgttgccgtgccgctcataatcgcaaaaacctgactcgtcagcatcatccgtacctttccgtctttacagccctccaccggattcttatgatcgtcataatagccattaaaccatccgcgtgcctcatcctcagcaatccactcctgcatccttatatgctccatcagccagtctgctttttcctccagattgctacagatctgctctgcttttacgatcatggtctgaccactgagattatgtgcacatttctccagataggcgtccagtatccctcgtttcttttccacattctcatacagctccctgccacctgcaaacagcattcccatctcttctgcaatctcaaaacgcttgcagctggtctcctgctctaacagccggatacagtgcgcaatctcttttaaatttcccgcataagcacttgtaaatgccacgctttctccattttcccatgccatatccagcgcgtcattccagtctgccccgtgcagccgcatctcattgtgcgcgccgacatcgtagaatgcacagagattctgaagaagcagatgttccagtacacttccgaaatagacgacgccaccctctgtgcgctggcattttccatatgtctcgtcccatccggtatcgtgatctgtgcctcttttggactgcagatccttaaaatacggaaccttctcaaaaagaatctcgagatctcctgtctggtcaatataaaattttgtcgtcacaaacggccagaacgcatgatccatccacacacgggtaatatgattccggtccgcaataaactccccctgcgcatttccgataattgtggcattggttccgtccacccggacaccgccgtaattgtcgatgatcatctgccggactgcggaagggtccatgagaagcaatgccagacaatcctgccacagatcccgccagccacgtcctccttttccgtaatcatgatacggcaggaacgaacagccgtaaattctccgcagaattggctggaacgtaatccacttaagataattgtctgcatccggattacccgttttaaatgtgatgtttactttctttgtccagtaccgttttacttcatcataagcttcctttacctggcttctttgtctgagagatgctgtaagaggttcgatctgtgatctctcgtcggtcattccgcccagagtcagatagcagactgtctcatgtggttttaataaaatctccgcaaatttaagagctcccactgcttcttttccctctgccttacttcctgccacagctcccggcttttctgtccggactgcctccggtatgagataggaacctccctccccgataaactccccgacggtcgggtaaaaagctgccggtgcctctccctctccggtggaaccatatacaaaatacgttgtatgattcttctgatgcccccgctcatcaaacgacatcgcaggcgtcacctccaccccataatccgtggtacagatccggtgcagcagggaagtcacatggcggtgatccctgatattgtccgcacttcttccatagaccggcatcactgcaatcggtgtcatttcaagcggttcctctgttatattggtaagttccgtcatcatcacttccatcgctccgtctaccgtaacaaaagaagtaatctctgcttttagtccatggactgcggatgtccgcgtcagtttctgccacataaatccggcttccagtacgcttttctcctgttctccggtaaaccgcagaaattctgcctctgccgacgaaccgcaggctgaccagtatccccggtttttgatacggcaccagaaatttcttgtatttttattgttatggagattttcaatactgaccggctccatcaggaaatggttctgatcccttttgctgtcgccgccgagtgtcggtgtaatgcaggattttaacccaccgtctcctgcaagaggaaaatacaatccactgtagtcttccggctgatacacccggaagcttccctgctgatccaaaaattctatctttcccacgaatctttcctcccatcttatgacatatacaatacgatttctgtctgctttttcaatacttcctgcggaatataatctccctgcatcctgactccatttacaagtagtctgtcgcatcccgactgcacatgtcccggatttttcacaacaatatgtaactggcagcctctgaaaactttatttacttcaaactcctcccattcatgcggaattgcaggcgtaagatgcagtccatagaaatccggacgcatacccagaattccctccacacagccgaccataaccgtggaagcagttcccgtgagccagtgcacatgtgaccttccgaaattcggacttgcctttccttccgtgaactgtccatagcaataaggttcaatcacgcggatctgtgcacggtcattctgtgcagccggtgcattttccataaaataagtaaatgctctgtctccatgtccccgcaatgcctccgccaggataatccatccctgcgactgtgaaaaaatacctgcattttcttttgcacccggattatagatgacagccagtgctccgtcaaaggcgtgcgcatgatacggcgggtccatcaatattgcaccatacggcgtgtttaatttctcatataccctctcaagcgccatatccgcctgatccgcttttgccagcccgctgatcaccgcccagctctgcgggttcagccacatatttgcctccggatccgtgcgctttccgatcacttcgcctgcttctgtaaatccacggataaaacggtcctcattccagcagagttcctgcagcaatttccccagttcctcctgcttttcatcaagataggcagccgtttctttatcctgcttgtattctgcaaactttcgcaatatattcatcgcataataaagctgcatggcaacaaatgtggattccccttctttgcccagtcttaagcagtcattccagtcggcatacagccccgccggcataccgtgttttcccagatggttcatggaaaaatcgatggcacgcttcagatgctcgtaaacagtcgcctctccccggtttgcatacggaatcacttcatccataaattccagatgtccggtctccgctatatacttgtagacggtcggaaacagccagagcgcatcgtctgcacgatatgccggatgcccggtctcctttacataagatgcatcatccggcgtatcttcatgtcccggattgtgtgtaaactttaccagtggcagtccgcctccattatccacctgtgcggaaagcataaacctgattttttcaactgccatctccggtgcaaggtgaatgactccctgtatatcctgtaccgtatcacgataaccgtatccattgcgcagtccacagtagacaaacgacgctgcacgcgaccagataaatgtcataaagcagttataggcgttccatgtatttatcatggcattgaattcttcactcggtgtctttatctgaaaatgtgcaagctttccatgccagtaatcggtcagctgctgcaattcctttccacagacctgctccggcagcgcataggaggccaaaatctctgccacctcaggttcctctttcattccaaccagaaatgcgaactcacagtgctctcccggtgcaagccgcaccaccgtactgagtgctccgcagctgttgccgttctcatttccctcgttacacaatgttccctctgccacacctgccggattgccatatccatgatatcttccgaggaacttctctctgtcgccgcaccaggatgtcactttcgctcccttcagtgcaaagaaacggctgacaacgattttatcatcgacatcgctgccttcctcgatctgatccagattcgcatgaatcatctgccgcacatgatccccacagaaaaccgtgcgcgtaataaactgcgaatactgtaaattcacctgatcctgctcatagttgctgttgtttgtaaattcagcgtacccggtaaccgtcagttctctttcttctgcagatgtgttggcaatgcatacattccacacctcatacgcccggtctagcggcacataatatctcacttctgagtgaataccgctgtaatccgcctgcatttttgtataagcagttccatggcggcattcactccggtaagttttcagatcctttcccaccggctgccaggaagccgaccagtagtctttgcttttattatccctgatataaatatatcttccgggttcgtcaaactggttaaagatgtatcttaaaattcttccgttagctccggattttgcaaaactgtatccgcctgcattgtttgaaataatcgcgccatattccggggaaccgagataattaacccacggtgccggtgtatccggtcttgtaattacatactctttcttcgtctcgtcaaaatatccatatttcatatatgctttctcctgttttgattttctaaggttttctacattaaatataaccttcctttgaaaatcagaataccagatacgacattaaaatatcagattcatgacctaactttattcagtaaatacgataattcccggacagtgccagcatggcaaacagatacaggaaattgtcgtaataacggcgttcccctgtccgaagcggcgtctcccagaaccttctgatgcactcctttgcattttctcccttcgcagccagcgaagcctctgcatttaccgctatcaccgcaaccgggtgcagcgcccgctctctaagaagcgtgccgtccgtcagaaacacaccatcccagtgtccgctctgcttttcgcagtaaaagctctgtaattttcccgcaatctcctgctgccagggatctctcccaaaccacagccagtccatggcaatattcgcaatcgtccggtacgcatcactgtaataccagtcatgcctgccgaaaatctcctgatgtccctcatgcggagtcccgtcatactccgcatactccgccgacaaaccggtgtccggatgacatgccagatgcagatacgctctgctcgcttctgccgcgtctctccagaactcccggtcatcttcgtccgcccatctggcaaataattcataaaaatggggcagatggtaagacggatcgctgaaattacaatttgtaataaacttgatcagatgcctggatgtgtcccacatcggttcccccggatgccccggctctcccttgtggatgcattcccgcagaattgcccgcgcctcatctgcatagtggaatattccggttccatttccccagcggtctgccgcaaaaaacagtgccatggcaaaatattcttctccgtcgggagccggaccttccgcatttttactgccatctgttgcacaggaccacgcaaaataattcttacatggtccatcctcgatgtacatatatgtccgggtccatttccacagccggtcaaactcttccctgcggttcatctgcacacatgccatcattccataggacattccctctgtgcgcacatcatggtttcccgtatcctctatgtatgccatgtcggctcccacctcatgatagaaacgctcctcctcattcccataaaaaattgtctcaaatgtctgctccactcttctctgaatctccgcttccggatacccgtactctgcaaacacattgcgatactttcccgtctcaaatgctcccgccatcgttctactccttttctcctctttcctttatgtgtgatacgtctctttgggtcccagataactttccaggacatccgttccttccgggcggatcaacagcttttccagaacaaacccaggtgtgacggaataaatgcgcagacggttgataccacttctgcatgaaaccggaatctcctgtctgcgtatctggtctaatacaccttttgcccagaactctccctgatctccgatccggtatccctcaggtactgcgttataaatccggatctcaccaccgttattctgcacaccgtagcagagtttctgatcgttcgccaccggattggagggctgcatataaagcgtaagtacatacccgccgggctttgatacccagaaatgatactccagatacggtgcattttctcccggcacaccatacgctgtgaccggaaatgctttcatggcagaccgcgtttttccatagtccctgatgcattgaaaccgtaccttttcgttttttccttcccgcttaccatccgctgcatatccatccttccggtctgcataatgctctgcctccatcacaatataacctgccgtatccacaaaggtaccttccggtacttccggcagattttcacataccggtatctcgatccggcagcagccggaaggcgtttttatttcaagcactccacaagcagacgtacctgtatttccatcccggttcattgcccaacgctcccggttcattacaagttccagcttttcataattgtgctttttcccgtccagcacgccctgcatcggacacaccgaaagccattccggtttttctgtgacctcgtatgcagcctcacattcactcagcccatacagggtgatcccggcgctcctgcacgcagggtctaaaaaatccggcagtttcatggattccgtaagccacgggcttccctctgcatgctgcatcgtctgatccactgtcacaaccagtctcggtttatccgcgggcagtacccggtgaatcacagggtttaaacattcatcctcattccagtgcacaaatccgatatgctccgatgctcccatgccatcccagcgtccgtgatccatctgatgatatgccgtcaccagttcccggtcacgcttcagacactgttctaccgcatccccgtaatcattcgcgcgaagtgctccaagctttgccaggtattgattcatccctgccagaagatgcatcctggtcagattcagtgttcctgccgcagggtaatagatgagcgccacaaacgccgcttcgtattccggcgcatgttccttcacccacgcatacacacgctccgcttccgtaagtatccgcttaatctcctccagtgtatcctgcgtttctcttccatgcaccgggtgatacaccattgcacgcattgcctcaggtcttctcttttgtatcaatctggtatatccctgcagaacgtccgcaatctgttcctgtatttcctccgtaaagcttccaaactgctgcctcgtccactgtctggtatactctgcggtctgattgacggcaccacttccccaacgtccaaaatcatatgccatatccagaaaatacgacagtgggaactcctgcgttgcaatatcccccacattgacaatccaaagttcccgcaccccgaattcatatgccgttgtcatttgttcccagattttcggaaggtacgaactgttgatccattcataggaaatgggccagccgtgatagtccagatgatagtacatcccatatccgcccttatgcgtcctcatctcctttgtcggcagtgtcctgaggtttccatagttgtcatcacacagcagtaaaataacatcttccagttcttccgatcccatcagccccgccgtctgatcatttccataaaaaaacgcttccacttccttgtagagagcaagcattctcgggacacgctttacgtcctcatccacacactcccggatcagctcattctgcgtttttagcacatcgcgcagcagttcaatattgtcttccaatgttgctttttctccgagaattgccgtatccgcctctccacgcatgcccagggtaatcacattttcaaattttcctctccgaagcagtccgtctttccagaaccggatgatgccttcccggttcgtccggaaattccatgcatcgccatataccgaatcttttcctcgcaggtacttatactcctccccctgtctcagacacggctcatgatgcgacattcccataatgattccgtattcgtctgccagctttgcgtttgcaagtcccgggccgtcatccccaaatctggcgctccacatcgccggccacagatagtttcctttcagccttagcagcaattcaaacacatgctcataaaccgaagttccaaatcccccaaagcgccggttgcaccatgttccaaatgccggccattcatcattgataaaaaaaccgcggtatcttacagacggctctcccgccacacacgccatcgatgcacgaagccccacatgttcacggtgaggtggcctgataccacaccagtcgacaaacggagatacgcccagaagttctgacagatgaaacagtccgtagattgttccacgcttatcgctccctgcaatcagaagaatctgtgttccatgccattctggatcgttcagaaaaaaccagccataacactcccgttttccccggatctgttccagaccgattctcttttcttcctccatctgctccagaagtctgctttttccaaccgtagccggaacaatcacagtctctgcccgttctgccacatccgcaagttcttcctgtgatgtgccgtacagcacccgcgggcgtctgtccgttaccagctccacatcgccggcaactttatccgctatcttctttaccccggaatctgctgcatcttccatccaaaatataatctcttccatattttcaatccttctccttaccggaaagagttcttcagctgctctgccagctgatgtctgcgggatgtccagtcagatccatcctgtacctttatcatcgcccgatgctcttctcccggtatcaaacggtatttttgaatgatctcctccggaatcctcgcttctttccgcttgctgcacttctgcatcacaagaatcatttccgtcatttttccctctgcgataagccggtcagccatgttggcgatttttccctgatgaatccacacacattcgctctcccaccgaaagctctccacaataagaacaggatacctctgttttgcatgcttctcatatcctgccggtgtatacacataacacaggcggtatccgccattttcttcctcccggtaccattccatatgaagcatgccatgcggcacattcgccagctgcggataacagaactccggttccggaatctcaaaataattgcatgcaaaactgccctgttcgttatatccggcataccctgccggaacttccggatgaatcgtctccacgccgttgacgataaaatgtacctcatgatagccggcagaaagtcctcctatttttcctcgccatattcctggctgctgctccgttaacgtagccaaaatctcatgcttctccttaagccggacatccacacgagccgcaccgggtgcctccagatagaattctgccgtgccgtcactgcacacttttacgcccggtatggtctttggatatttccctgccggtctcccctgcgcatccgtttcaaaccggatctgccggtgtaccggatcaaaaaagagcatctgctcctccatgctctggacggacagctgtttttcatccaggcggcgctccatgcagcatgcagatgccgtttcttccacagtctctgcgccacaaaacagaagcggcacaaaatctctcagactctttctccagacatgccattcatgatagccttcatatactttctttacgcaaagcgtttctgattcgcgcatttttttacagatatcctctattccgcgcgaaatctcctcttccctgctcccgcaggagaaaaacacaacatccggtttttctgcctcatccgtgcagatcctctctgcgtcataaagcgataccccggaaaacattccaagtgccgaaaatttatcccggtgcctgcatacacttcttgccgccagtgcaggccccagtgaaagacctgccagtgcccggtaatttctgccccgttttaccggaaaatgtgtttccacataaggaatcagatcctccatcagctctctgtcaaaatccccgggaaagaaaattgcctcctcaccctcgataaacgcataatcacagctcatcaccacgatcatttccctgcatttatgctccgcgatcagattgtccatgatgtaatttagcttcccctgccagatccatcccgtctcattttcaccgacaccatgctgtaaatataagaccggataccgccggctgggatctttctggcttccataaggcgtgtatacataacattctttcaggtgaccgtttacaccggatgcgtactttgccagatgcaccgttccatgcggtacctctttcagatagtaaaattctgctccgcgctccggcacctcaaatgtgttgattgtctcaaagcagccataagaaaaaccggctttcggatgaaacagtttcactccgtccacaaaccagtgataatagtgcattcctcgcgggaagttctctatcttcctgtaaaaccctccgtttccatccggcaggagtgcaagcggcgccgcatcaaaataaccgcccacacccgccacttccaccgtctcagccgtcggtgcatacagatagaattctaccgtcccatcttcccacaccttcaccgcctgccgttcttccgttatctccggcgcaaacgaaagtgcctgctgcaccagcgcctggttaagttctgtccccataaaaaaacctcccattctataagatcttctgtgagaatatcgtatagaatgaaaggttctaccggcagatgcggcgcatcacttcctgctgcagatcctccatcaaaatctgtggactgcaggcattgtatgcatccatgtattcctgccaggctgtatcaaaatcctctgccataataacccgcggaagccactcgtgcttgatctcattgatctgctcatataccattcctgcttctgtggtatcagaaagcgatgtagcgtaagaatacatcggataccagtttcccggtgccttatgattcccaatcatatccacatagctttcacagccatacgccctgagacatttctggacgtcccccggctggctttttaaaaattctgccggctggtattccagtgaaaaagcatttttcccatccggaagcattccctcccaacgtgggaaatacgagtaatagcagaaatagtccgatgccagcagatcatccgaaaaacgctttgactgttccttcgtcagatagaaaaccccttcctcatccacgcaatagtccgttccttcctgcccccagaaacgcagaatctccacctccggctttaaaagatcattcacaaactgcaaggcaccgtctatgtcttcacacgagaccgtaaccgacaggccggaggacgtatcgatagatgccgctctctcgacatgccactggttctccaccccctcctgcatcgtaatcggaagcggtacataatcgcatccctgctcactcaatttctgtctgtcatatgccggataaatcgcatagtaaaactgccaccactgatccaccattccaaggaccgctccggtggacagcttattcagatactcttcatagctgtttgtgaacgcctccgcatccagtattcccttacgatattcttcatttaatttttcaaaataagcccgcgccgtctctgtcgtgttgtaatccatcacctgaaaggtctgcggatcgaccatgcagcagccgtcattgggatatccatccagaaactgcggcacattctccaggcaaaaatatctccagtcatcgctaagaaccgtaaatgggatattcctggttccgttctccatcatgggattggcattcacataagcctccagcagatcgaaatattgctctaccgtatgaacttccggatatcctgcccattttaaaaccctcgtctgaatccagaatgcttccccgtcatggatcacatcgctgctttttccatttgtcaccccgaattgtggaatccagtaaatgtgtccgtcttcctggcgcagcatatcccactgctcattcgtcatgtattgccggatattgggatattcctcccagtactcatcaatcggaatcaatgcctctgcttcgtataagtttttttccccctgtatgaagtccggatatctgccgcgggcaatgtatgaattgagtgcctgctccttggtctgaccggacagccagagttcttcacactctgctcctgtcacctctgcaatcttcgctttcatgatatttccatattcaaggctgtttccctccgtcggaaaaaaagccgtaaaatgctttatctgcgcttctgccatgcggtctgtgtgtgccgccatgttccacagcaccagaagcagtaccattaaggtcattccttctgccagtctctttttcatctgttttccctcttttccagtcaattatactgtttttaagggacaccggcaagatgggattgcatacgctccttcgcttttatatggaattattcttttacgccaccgagtgtaagaccggtgacaaaatatttctgtaaaaacggatagatgcagataatcggcagcatcgtgagtatcgttgccgcagagcggactgacgtcggtgtaacggttcccactgcattcttcatggcttctgccgaagttccctgattcgtgacggatgacagcagcttcatcagctcatactgcagcgtcgtcagatcagaattcatgcggttgtacagcatggcatcaaaccaggaattccattgtccgactgcaacgaacaatgccaccgtcgcaaataccggcttgcagagcggacagtaaatctttagaaaaattgtcgtatatccggcaccgtctaactgtgcggattcttccagactgtccgatataccattcatgtaagtgcggattaccagcatattaaacgcacttaccatgcccggaattacatacacccagaaactattggtaagaccgagtcctttgtaaagcaggaatgtcggaatcattcctccattcacatacattgtaatgacccagaacagggaaaggcttctcttaaacagaaatcgtttccggctgacaacaaacgccagaatcgcgtttgcagccagtgccagcactgttccgataactgttcgcgcaaccgtgacatatgcaccggtaatcagattatctttctgcaataccgtgatataatttttccatgtaaattttctcggccacagataaattccgccacgcaatgcatccgtgccatcgtttaatgaaatcgccagcgtattcagcaccggatataatgtgattacaacaatcacaagcataatgattccgttcacaatgggaaatgcatcaacggatcctgttctctttctttttttatttgctcctgccagctgttgcatgctattaccctccttagaataacctttcttctccgttgcgctttgcaatctggtttgcaatgacaatcagaatgatacttaccgcactcttaaagatacctgcagccgtaccaatggaataatctccctgactgataccccatttaagtacatagatatcaatcgtctgagacactttctgcaccagtccgtttcccagaaggtactgaatctcaaatccggcatttaatacatttcctacattcattaacagaagaatcataatcgttggtttgattcccggaagtgtcacgtatttgatttttgcccatcttcccgcaccgtcaatggaagccgcttcatacagggacggatcaatggatgtgatggctgccaggtaaataatggcattccatcctgtctctttccacacattggcaaacgcgacgatcggccagaaataattcggatgtgcaaaaaaattgattggctgtgtaatcacatgcagattcatcaatatctcattgatgattccgcttcccgagagcatatcatgcagaattcccgttacgataatccaggacaggaaatgtggcagataagagatggtctgaacaacctttttcccgccatgtgattttatctcgtttaagagaatcgcaaatgcgattgctgtcacaaatgtcacaaccaggtttatcacacccatcgcaagcgtattccggatgacacggataaatgtcatatccgaaaataaggtctgaaacttctgcagtcccacaaactcagagtggaaaattccaagctttggcttataattctggaacgccatcgcccatcccgccagtggaaggtaatagaaaatgatgccatagattaccatcacaccactccagaacagcagaactttctgtctctttatttctttccaggtgatctttgctttatattgattttctttttctttggatcttgttctcgtcaaagccataccccactccttaaaaaaacaggcagatgaaatcttccttgcatctgcctgtttccaatttcattttatgtgttattcgtatttcgctgcttcttccattctcttatcaagttctgtctgtaactcaccgataaacgcacccggatcgcagctgttgtatgcatccatgtactctgcccatgccgcgtcaaaatcttttgccatcacgacctgtgggagatactcgtgcttgatctcaccgatcttattccatgccataccgccttccgtatcggtagtgaagctgtttgaataggaccacatcggataccatgcacccggagcttcatttgttccgatcatatccacataggtctctgcgccataagcagaaaatgcttcttttacatcatcatttaatccgtcaaaaaattcattcgcctgtccatccggcttattcgcattgattccgtcatcacttgtaccggaatactgcggaaaataagaataggtacaggtatgggatgctttgtatgcagtgtcaaccgctctggttctctgctcctctgtgcggtaaaattcaccgttgtcatccacattatagtcaacgccttccactccccagaaacgcaggttgtgaatatcctgtgagaggaggtcatctacaaactgcagtgcagcttccacatcctcacagcttgtggtgatcgcaagaccgtctgatacatttaacacaccgccggaacagtgccactggtttttgacactctcatcaatggtaatcggaagcggaatgtaatcgcatccctgtgcatccagccctgcctgcttgattgcatctcccgcagtgtaagcaaaatcccaccactggtcaatcatgccaagtacacgtccggttgacagtttggcaatatactcatcataggtctgtgtaaaggattccggatctacaattcccttctgatattcttcattcaatttctggaaatactttactgcggtatccgtcgtattataatcgatcaccgtcaatgtctccggatctacgatacaggagccgtcgtttggatatccatccagaaactgcggcgcattctcaaggcagaaatatctccagtcatcgcagagaatcgtatacggaatgttctctgttccgtcttccatggtcggatttgcctcattatatctctcaatcagatcaaaatactgatccatggtacggatctctggataatccgcccattttaataccctggcctgaatccagaatgcctcatcgttgtgtgtacaaaccttctcttctcccttgatattgctgaactgcggtatccagtagatatgtccgtcgtcctggcgaagctgatcccactgctgctgtgtaaagaagtttttgatattcggataatcatccagataatcatcgagtgctaccagaacgtctgcatcatagagctgtgactgtccgcttcccccgcagataaagtccggcagctcaccaccggtgatcatcatgccgacagcttcctctgccgtctgtccggtcagccatgtttccttcactttcacgccggtcttatcggcaatgatctgctgaatctcattgtcgtcattgatctctgaaccgggaactgcaaaaaaagccgtaaattcttttaccccaccggcttccgtgctgtctgcaccgtctgcgttttcctttgcgtctgtcgatgccgcatcactcccgcatccggcaaacatggctgccatcattgtggctgccagcaatacactgataagtttccttctcttcatcttgtaactacctccctatttgataatactattttacctttctggcagattcagacaattggaggaagtatagataaaagcagggcaaagtataggttcttatttccatactttgccctgcttttgaacttgccgtatttcctttatgcctcacgccggaacttcgccggtgtacagccttttaccagaataaaacggttcacaaaataatcaagatcatgatacccgacttcctccgcaatctcgacaatcttcttatcggtatgtaacagcagatccgctgcccgttccattctgtaattattcagataatctttgaatgactgcccgtttttcttacggaacagctgtcccagatatgcgctgttgacgtaatatttttcactcaggctctttaatgtgatattctttgcatagttttcccggatctcacgctcaatctctcctaacactcctctggatacatttttgcgaagctgcgacagatagtccccgtattcacatgcaaaccgggtcagatgcgccttgctgccgcgcattacccccttttcaaagctactctcactgatcaggcgcagaatctcttcctgatttaccccgtcatcctgctcactcgccagatggatcagctgaaacagaagataattgatgttcagattcatcgtctcaccggtcatttccctgcttatcatctccccgtaaaactgctcaatcgcactccgtatctctacatggttgttctgctccacagcttttaacagacgatccagactgctcttgcataaaacaattcctccggaagtaacctgcacttcctcctcatagtaatagatcggcttttttgtgcggaatccctgaaaagaccggagcatacacgcatttccataagatctggcaatgttgctgatatcctgcacctttttccctacaagcatgatgaccggctggtgcatgttagcaatcagatactcaagaaaccggttcagatatgttttcccatcaatcccctgctcctttgcaaacgcatcacaatacaataacccgatgtcataaatcttctcatgcgttgagacatcaaagacacaatgtgatgcatggggtcccaggaactcaatacaatactggtacagctgccgctgaaagccccgtttttccttatctgatatttcctcggctctgccgtcatcatccatctgaatctctacataccgtataccggatgccccatccatatgcgacttcacatactccagattcacactgtcaaactttccctgaatcaatgcgatcagatgtctggacagatacgcctgctccatttcccggctgctttgcttcttctggttgtccgcccttcgcaatacctggactttattcagcaccttcagcaattcttcccggtctaccggtttcaaaatataatctgtgcagtcgtaacggatcgcctttctcgcatactcaaaatctgcatatccgctcaggatcacaaaatgtgcatcggaaatcttttccctgcgtattttttccagaagttccagtcctgtgacgaccggcatttttatatccgcaataatgagatctacctgctccccgcgcagatattccagtgcttcctctccgtttgccgccgtcttaacaacttcaaatccctcctgctcccagtcaatcagtatcttcagtccctgtaatataaacggctcatcatccacgagcaatacctttaacaatgcttcccccatctttttccttcccttctctacaatggcatccggatactcactgtcgtaccgataccctgctccccctctatatcaaatgccacctgctccccgaataccattttcagccgcagacatgcattgatgattcccactcttccgccatcctttagcatatcaatactggcgtttagcatgcgctcttttaattcctgcatctgggaggcgtccatgccgcatccggtatcttccacttccagataaagtgccttctgcttttggcagatccgcacaaaaatccagccgggagctgtctttgcctcaattccatgtacacaggcattttccacaaaggtgacaactgtcattttgggaattttaatgtccaaacaatcctcttccacttcaagactgtaacttaaccgctctccaaaccgatacttctgaagccccagatacgctctcacaaattccatttccctgcggatctcgacactgtcgtttccccattccacatactgacgctgcatcagcgccagcttttccaccatgtctgccgtctcatattcgtttttcaacaggctgtgcatgcggatgctctccaacgcattaaacagaaaatgcggattgatctggctgtgcagcgcgagcagttctgcattctgtctttccaccagcatctcctgttctttaatcttattcttatacacaatctgaatgagttcatttgttctcgcaaccatgcggttgtaattgctcatcaggcttccaatctcatcttttccacgcacatacgaaatcggcaccagatgttccccgccgactgtctcaaacactttgctgagttcgctgattctctgcgtaaatgaccggttaaatccccgcaccagaaggagtggcagaatcgcatttacaacaattaagaatccaatcagcggcaggtttttccggatttccgtccacagctggcgtttgggctgcatgacataaatatccagatccattccgtaaaactcaagttcctgacagtatccgaccctgcccgtctggtcaaatgtctgaaattcctttccgatactggaatatctgccatttgataagacaatcttatctccctggcagataaatacatccgtgtcataattcattttctctaatgtccggtttactgcactgtaatcgatgttgatcagcagcaccttttccatattattttccgcataaaagtccagcttctggaaaaaaagcatccgtctctgcggctccaccgaaggtgccctgctgtcatcatactggaaatataatcccttattcaatccgttatcctgaaaatagcggtacacttctgtaccgcgtatttccttcatattacatacctttcccccattcacgatcgtgtcattatccgcatacatcgtgattaccatgttgttcatgccaagtccgctctcaaacagggtatctttaaaaaaatcctgataactcaccacatagtccaacggatcgctgtaggtattcgccaaaaaacggttaatatatttgctcgtataaatactcttcccgatctctgctgcattgttgaccgtatttgaaatactgtatgcaactgcattggcaatattcgccatctcatgctctctggcttcccgctcagacttcatgacaacagaaaataccgcactgtccgtcacaatcagcggaaccagcacgcacaagatatacaggatataaaatttattttttattttaaagtcatccatccaggcttcaaccgcatgcagaattctcttcatatcctctcccagtatttttatactaacattgtttttcatcgagtgcaacggataccggcagcatcagtattccacttccgtcacatttcccgttttgcatataaaaagtgtgctcaccgtctgtccggtcagacggctgcttctctcatccggctgctgccctccgactgcgatctcatagcttcccgggtgtaccagacattttccctcctcggagatcagtgcaaaatcacgcggagaaagggtgatacaaacctctttcttttccccacattccagtgcaaccgaccggattcccttcagctgatagccgggatcgtaagcttctctttcactgaatctgacatatacctgtaccgcttcctgtaccgggtaggtaccggtattctccaccgttacatgcaccgttaccggctccagtattccaaaatctgtgacatctgcatgtgcatcagaataacggatctgcgaataggtaagaccatatccaaacggatagagcacatgtctgtccgtataccggtaggtacgtcctgccatggaataatccgtaaaatccggaagaaattccgttccttcataaaaggtaaccggcagttttccgcatggagagaattctccgaacaatgcctctgcgattgcttttccacctctcgctcccgggtaccagcaatccagtattgcccgtatctgtgcatgttcctgcgcccacgacagatccagtgcacttcccgccagcacggtgagcacaatcggttttccgactgctgcgaccgcctctaaaagttcctgctgcagtccgggaagctttaatcccagcttgtcaccgctggcatactcatttcccgcatctccctcttcgccttcgatgcccgcatccaatcccagacacatcacaatgacatctgcccgctccgcagcaatcagcgcttccttaaaccggtccttcggctccccgaggaattctacctgatccttatacagatggcagccctgcgcatataggacgcgggttttctctccggtgtattcctgaattccctccagcggtgtaatgtatctggaggatgtcccctcataatttccaaccagcgctgctctggagttcgcgtttggtccgatcactgcaatggtatggacctgttcctgcttcagcggaagaaaatggttgtcattcttaagcagcaccatacttcttttcgaggcttctaaggacagtgcaatatgttcggggcactccaccacatcataaggaatgttcgcatatggagacggataatcctccatcatccccagccggattctaacatccatcaggcgctccaccgcttctgtgatcgtcttttcctccaccagtccctgttcacaggcacggcttaaatacaaaaatgccttcccgcagtttaaatcacagccatggttgacagccattgccgcagattcttctaccgtctttgtcacatgatggtgctcatgaaaatcaagaattgcccagcagtcggacactacgtgtccctcaaaaccgaattgttctcttaaaatatcctgcagaagtgtcttgcttccgcacgccggttccccgttgacgcggttataagcgcccatcacggcttccacaccggcatccttgacacaccgcttaaatgcatacaaatacgtatcgtacaaatcgtgcagcgacacctttgcatcaaactcatggcgcaatgcttccggaccgctgtgcacggcaaaatgcttggcacacgcagccgcctttaaatgatccggatctttgccctgaatccctctgatatacgcacagccaagctttgccgtcagacagggatcctccccgtacgtctcatgtcctctcccccagcgtggatctctaaaaatgttaatattcggcgcccagaaagtcagacctttataaatacctctgtctcctcttcctgaatacgcttcaaactttgcccgtccctcggtggacaccacatctccgatcttctcaatcagttcttcatcaaaagtcgctgccagggcaattgcctgtgggaacattgtcgccacaccggatcttgccactccgtgaagcgcctcattccaccagttatacgccggaatatgcagccgctcaatcgccggtgattcatagcgcatctggctgatcttctcctccaacgtcatctgttccaccagtctttttgcatattctttcgtctccagactcatctctccctctccttttgctctattcttctgctccactgcacgtaaagctcacataatccgcataatttttactgtcagttccatgcgaagacgcgtacattccaatggtgcatcccacaaagcctcccgcctcttccgtggtatacgcaagcaggctgaccttatcgcaggcacagatcattttttctcccagccttacccagatacccgcactctgctcctctccgcggatcagaatctcccataactcctgctcttctttcagaagaacttcacggatgacctcttccctggcatgaacatatgtgctcacccgaaagcagacatctgttccctttttcccgatctccatcctcagatgattctcatggttctggtataataccattcccgccgtctcatcctccgactgtggttcaaagcggaatctgaccgctgcatggaaatgatagcttttctgccggagtccgaaataactgctgcatcctttttcaccgatcgtctgttttccacagtataagcggaatacaccgcgtttttctgtcagcgaataggatgcctcatttcttcccccgatcccaagcagcctctgatccggtctcgtctcccagaaacacagggtatcgcacgttcctgtttcttccggaaaccggtactcttttagcggcacttccagtgtcttctccagacgtccggttccggcagcaattaccggccatccatcctgccatacaacttttgccagaaaagtctcgcgccccatacttccatggttcttacagcgtctcgtggcgagcatcaccacataccagttcccgttttgatcctccaccagatccccatgcccagcatagaccacaggataatccgccccaagattccgatgtgtaaagatcggattgcgcgggcatccctcaaaccattgaaacagctttcggcttctcgccacactgatgctgtgttccggtccggttcctccttctgcatgcagcagataataatagccgtcttttttgtacagatgtggtccctccggccagattgcccctctcacagcccctttccagattgccatactctctccgaccagcttcttcgtcgtcagatccagttcctgcacccagatctcccagtccccattgtaccttactccatcgggattcggtctggttccgcaataatagcacctgccatcctcatcaaaaaacaggctgggatcaatcccggctgcttcttctcccagataacagggatctgaccacggtccctccgggtgctccgccgtcacaataaaattacctccatagctgacatttgtggtaatcatataataaatacccttatggtatcggatggtcggcgcatagattcccctggaaatctcctctcccccaacagcaagctgctcttttctctgcagaatatttccgatttgctcccaatgtgccagatccctgctgtgaaacagcggaacacctggtgcatatgcaaaactggatgttaccagatagaaatcttctcctacccggcagatcgacgggtccggataaaatcccgtcaaaatcggattcttaactgtaaccatagcttttcccccctactccacatatccaaatccgagaatcgtaaatttcttatccagattctcaccgctcatctggattctcacggtatgtgctgccgtttccttctcctgaaatacgagcaccgcattacagtgcagccagttattgacatgtggatctgctgtgaaccggaattccccatccaccagcacatccgctgtcccggcatccacctcgccggaatccttaaatatcagaaataacgctctgcatgtgatcgtcagttcaaaaaacgcccgatccggcttagttccatcatacatccagttatatgggaattccggcgtagtgcaaagatcctgatccatttccacacactgcagttcgtgatctgtcgcatcaaagcctccctctctcatactggcaccctcatatccgtcccgccggtctaagagttttactttttcaaacgaattgccgattgcaggctccccgcgcagacactgttctaagacttcctcctccgtcatgccctgccggaagctgtccaccctcgcatggtcggacgtatcacatatctccatcaggtattccagacaatctgccataatggtatgtccaaggttggtcggatgaaacatgtcataaaaaaactggttcttcgtaatcactcttttctgttcttttccggaaaactgcggggtaaccgcatccagaatacttaccatcggaaggtcgtactgtcttcccaccggctgcagacgttcctgaagattccagtcatttgcaaatacggaaaacaagagtaccaccgcaggtctccacggcagcttcaataccttacgcaccagactctcatagcagtcccctttggtctcatctccctcatcattcaccgcaaactcgattacaacaagatccggctgttccccctcacgcaacacatctctgtcaaaacggatcattccaagctccgatggggttcctcctactcccgccttgatgaatctgacattattgttccgtgcaaatcgtttctgaaacagctgatatgccttatatgcataacactctgtgtgaatcggcactgcccctgccccctgtgtgatggaccctccgataaaagcaagcgtcacttcttttccggctcgcgctttctcaatcactttccggatgcggtaggtatttcccaggttcataagagagcgctgcaccatcttataatattcttccgaatggagatccactttttcttctgtcagatcttccggtgccgtaaatccgtcgtttaaataaaaacggacatctgcctttcccacccgttccggctggtcaaatgtaaagcggatctgtccgggcacatcatcatccagactccattcataatccgacagacagatcctctgttccatcccatctccctgcagtgttgccaccagattcgttccgcccccatacaaatcctttttgccgtacatctgaaaaacaaattctatcttttcagccggatgctccatctcaaccgacacaccaatactgtgtacaagcgtgcggaagcctttcactgtaccgagcagttcaagtattctgctatccgtgatatttccgacaatctgtgcactgtttgccagacggccgtcactttcatagatgaactgcactgctttgccatctccctgcttcagtccgcagatctcttttccacgcataatataaaaatgtgctcttgctttttccgggtctctcggtgccactggtcctgtcattctgtgctcctcctgccattttattttatatacatctatggtagcacagatttccttccggatacgcgggagaaactatagatattactacgataaattagtgttcttgcccctgcccccgcggagcgttttaccggaagccgtcacatcagaaataaacggctgcctttatgcggtaagtaatgtgaggagaaccgttctttttctgatgtgactgtcttccggtattgattcggcagcattccgtaccgcttccggaacagattggaaaatgccttgctgtttggaaagccgtggtttaatgcaatctcgccaatcgcaagatccgtctcttccagatccctcacggcatgctccagacgcacactcgacagatattccttgtaattgatcttcgcatatttttgaaacatccgggagagatacgccggtgaataaccaaaaatccccgccagtttttccagcgaaacatcctccgtataatgctccttcagatacccggtaatccttccgagacgcttaagctgcttattgttcttaagtatctcttcgcccacctcaaacttccggtatcttgtcaccagaagatactccagctgataaaaacagcttagcatttttaattcgtaaccggtctgtttctcaccgtacgccacaaacattgtctcgagcagagaaaacacctgacggtcatcctcttttccgctgtgggaaaaccagataaactgttcttccgtataataatccgcaaagacggcaagcggaatctgcagcacaatcgtctcgtttggcaggggagcatggatcgcatgcacctcattgctgttcaccagcacaaaatcccccgctgcaagtacatattttttctcattcaggaaaaactcaagctgcccctgtctcacggcaaatatctcgatagaacggtgccagtgcttctccctgatgtattttccgccgccgccctcaaagagaaacagcttaaacggaagtcccctgtccggaacgatcacttcatgctgataaacaatatcattcactccacttcggtctcctttaacaaaatttcattaccgcgcagtaagctgaaaccgccggttttcaccagccatcctcataaaatatactgtatgttttttattttgttaaaagtataacataaatttcaattttctcatttatttttcacaattaatttatattttgtttatctttctttgaaatactgcacaatttcccttgtcttcttttttcgtcttttttcgcacttccacaattcttttgttttccctactccggcagactgtccgacaaacataaagttccccaccccacctgcggattcggatattcctgcagcagaccagaagctcttcctcctcccagcgggcgcgcaccgcggatcaggtacgcctttattttttctccgtacaggtacacatcgtttccgcgcacaatcccccactccatcagaagcgcggcgctccccgtcacaaacggagttgccatcgaagttccggaacgcgccgtatagcctccgcccggcgcacaggaggtgatctccacgcccggcgctgccagatccggcttgacctgtccgtttccggtaaatcctctgcctgaaaatccagccagctgcccgaaccgcgcgtcgtacgccccgaccgtaatcaccttcgccgcagtggacggaatggtaagcgttgtctcctcccgcggcagaaggaatccggtgccttcgtttaaaacgcctcccgccgggaaccacatatcatagcgccccgtgacgatgcgctgcggaatcaggcgcaccgtccagattccactgtccacatagtcgcgcacgggaaggaaatccaggtagatctcctggtaagggctgtatgggctcggctctccatagtagagcagaatctgcgtctgccccagcgtaaaacgctgcgatccctgtatctggcggatcggtccgatctgcatgccgcccggatgaatgagaagcaccgccatctcatccgcataggatttccagatctgaagatttaaggcgctctcgtacgcgctcaccgcgaactctacattttccgcctgccccattccaagcgctcccgccgtgtgcgtggcagccgctccctcattcccgcttccgatcacgatcgagctcttccagtagtttgcgagatcatccagataagtctcgatgagcgacgttcccgtgtggcttccgtaattattcccaaagcttaagttgatagcgaccggctgctgccgctcctgcgcttttctaatgcagtaatccaccgcctgcatcagttccgttgtccgcgggaacgccccctcccgctggttgccgagctttacaatcaaaagatcgctctcatacgccacaccgcggtatcttccctccgacgctcttccgttgccggcggcaattcccgccacgtgtgtcccgtgtcccgatgcatccctgctcgggcagaccgcataccgctgctgttccgtgggctgcgcgagcgcctcgttgatgcgcgcctcatcgtactcggttccaaggaaataccccgccggcgccgacaagcccccggacgccgggatcgtctgatcccagagactgacaatgcgggtcgtaccgtccgccctccgaaaatccggatgcgcgtaatcgatgccggaatcaatgaccgccacaaggacaccggcacccgacaggccggttctctcctgcagctgcgtaatgcaggatgcacgctttccattgtccaccgcgaaaaataaaagtttcggcttttccatgtactcgattttatccagcgctgccaccggctccacgagatgttccggcagcactaaaacggcatattcattctgcagatttgtcagtcgaatcctcggatattcctccggaaaatttttaaaaaggagcgcctcaagctcctccgttgtcccgacaaattttacaatgacctcccacgtctgttcggcactatcgtagccgatgtccagctccagcgacttctcccgctcctcctgtgtcgccgccagtgccagattcagcagattctccattttttcgttcggcataaaaaatctccgcaacaacatcttatttctattagatgccgccgcggagaccgttatgtctgcctgtattctgtttttgtctgttttttatttcacccgctcagaaaacatcataaagaagctgaccagaagacatcccaccgacacccagatcatgtgaataccgtagcgcatggacagattgccgccgatgcccgccccgatcgcaaagaaaagaatgattccgaaatagtagagcgactgtcttaactgttccggtctcttgtcccgcagatacatggaaaatgccgccgtgccgctccgcagattgccaatgcacatcgtgctcgcataggaatagccatttaccttgcggaacgtctgcacctgcatcgcgcaggcaaaagacaccagcaccgtcgccgccatgttgtattcctgcgggataaatcccactgcaaataaaatcacaatctcaagcagcagaattccctgtctccagtgaagccgcttcgcgtatttgaaacgcccctgtatgcgctccgcaaaaaacacgccaaacgcaaacgccagcaacgggaacagatagcgcagtccgtccatccatctgcccaccataaaattctgactcatcagcaccacgttgccggtctgggcattggagaagacctcctccctcgtattataggtataggcatcctgaaatcctccggagaccgccagaaaaatactggtcagaaatgcctctgacatctgaagttcgttctttttctcgttcataagtatctctcaccctttcacattcttctctattatagcggtttacgtgagatgcgcaagtacccgttttctgccggctcataatttccgtttgcgcggcatacactattccagtatctgaatgtgcggcagcctgccggcgcattctcccatgaaaggagtattttatatgtgcggaatctccggtttctgcgacttttctaaaaattttaaaaaggaacccgtcctctgggaacgtattctcaccgacatgcatcacgcgctcgcccaccgcggcagcgacagtttcggcacctatttagacacgcatgtggggctttcccacgccagactcagcatccgcgatattgcgggcggcagtcagcccataatccggcaggatggggaacgcacctgcgcgatcgtctacaatggcgagatctacaacaccgacgaactgctgccgccgcttctcgccgctgggtatactttttccaccacttccgacacggaagtcattctctgcgcctatctgcactatgggagggattttgtcagccgcctgaacggcatttttgcctttgcgatctgggacggcggaaccggtgaactgcttttgtaccgtgaccgtgccggtaccaaaccgctcttctacagcaccccgggcggcacactggtctttggctccgagccaaaagcgctcttctgccacccggatatcacgcccaccatcgatgaaaacagcctgttggagcttctgtccatcggtccggcacgcacacccggcaacggcattttttccggcatgcacgaggttctccccggtcattatcagattttctcccgggagggcacgaagcaggtgtgctactgggatcttaccgccgccccgcacaccgattcctatgaaaaaacggtggagatggtctcttatctggtgcgcgatgccgtaaagcggcagatggtctcggacgtcccggtctgcacctttctctccggcggcatcgactcttccatcgtaaccgcgatcgccgcaggctgcatgcaaaaggacgggcagactctaaatacgttctcttttgattttgcggaaaacgataaatatttccagtcaaacgcctttcagcccgagcgcgatctgccctacgtcaacatcatgctcgcccactgccagacgcaccacacctatctggaatgctcccagagcacgctttatgaggcacttttttcggcggtcgacgccagggatcttcccggcatgaccgatgtggatgcctctctgctctacttctgttctctggtcgccagacacaacaaagtcacactgaccggagaatgtgccgatgaaatcttcggcggctatccctggttctaccgcccggagcttttaaaccgtgacggttttccgtggtctgccgatgtctctgcgcgcgccgcattcctgtccggcgacgtgactgaccgcctggatctcgccggttactcgcgcgcccgctatgaagagactataagtgcttccccgaagcttcccggcgaatcgcccgaggaagcccgcaggcgtgccgtcggctacctgaatatcaagtggttcatgcagacgctcctcgaccgcatggaccgcaccagcatgtactccggtctggaagcgcgcgttccctttgctgaccaccgcatcatggagtacgtcttcaacgtgccgtggagcatgaagtatcagaacggcgtggaaaaaacgctgctgcgcgacgcctgcgcggatctgcttccggcagaactgctgcaccgcaaaaaaagcccgtacccgaagacttaccacccgggctacgagaagcttctcgcggatcacctgcgccggatcataagcgatccgaacgcgccggtctacccgctgatcgatccaaaaaaagccaaggcattcctcgccgctcccaaggagcttggcagaccgtggttcggtcagctcatggcgggaccccagcttatggcatattttatccagctcaatgactggatgggaaaatatcatctgtccgtgtaaggaaaagaaaacgcctccagaatcgtgtcctcctaatatgcgcaaagcagatactacagtggattttcttccgcccggcggtgaatctggaaccgaagtgatatcggagccaatctgcaccatatccgcaggagacagaacaaaattattcacattgaaattctgctggatgcgctccgcgtgaactgacttcggaatcgccacaatcctctcctgccgcaaggagtgctgttggcagagcggtcggggcagctttcctgctgcgcctcgccgaccgctttttcagtgggatattccgttagctggagaacgagcaaaactgaaatcttccgtttccagacttgtttgtatcctttttcccgaattgggaaacctcgttcctacacttcatatggcttccgtctatgccctgctttccgagtttccaagtgcagacacagttgcgaatgctcatcttaatggaagaattttttgtcttaatggactgcttggattcctttaatgctgcccgatactgcctgaacattcccttctttgctttatcaacctttttgattttcaattttctcaccttctttcaaatgccaacaaaaaaagccgccatgaagatgtactctccataacggcttagttaaatgttattttttccttttgtggctcttgggattaagcctcatttcttttgccattcttatttcttcttccccaagcttacattttctttttgcttcgtcccaaagttgctggctgtatgccatgaaatcacatcctttcaagattttcttcttgacaaacaatacatatacctttactataggtgttaggaagaaacgaagtttactaccgtacagctattgctcatgcggcttgctcgtttctttttttgttcttaccaaatcatatagataaagttttccatctgcatcacatcttacaagcattcttgttgaaaaaatgttataacgctccagatttccatcttcatcataaaccggtattccaaatcttgtattataacgataccatccaaattgtgcctttgccccatgtttattcttataatcaggatactgtgccttttcagaagcaatctggataagttcaccaatagcaggcgtaatgtttgctttcgctttcatattagcaccttttaatccctttgtatcatttgaatgactgaactcatctggaaaatcagaaccgatatatattttctctgaggtttcggatatttcaaagtattctccaatatattctttcagatactgctctacttcattccaatctatccccttcctcgacttaaatcttatatcattaataagggctatttttgaaccatccaaatccgtaataatactgacacttttgttcatatttctcgtccttttctcttcgtatcagatatctttcgacatctgatgcgattttaccataagtgtcacaattatactatgaatttttctgcttctccttcgctttctgttcttggattatttcgtgtaaatttgtgttgcatcaatctgataactaagatttgtcaaggttccctgacaaccagcaactgcacttttggcacaatccggaatagccgctaaattttcttccaaatattttgctttttctgggtcattcatgcacttctttaaaaatgcacttgatacagataccgttgttgggatcctgtgattgccataatcttaccttcctatctgtttttactttgtctgactagtttctttctgaactttatcagtgtttttcttccaacaactaaatcaatattgctccttttcaacgcttctatgccaacgcatcaaatgacgatgttccgctttccatcactcctatagatgttgaagtacctagcagttccaccagttttcctgtcagatctgccacatctttgccatctattctcagattatattgccgttcttcctgctcctgtttttcggcacgctgtttttccagccgttcttctgtctctttcttttctgcttttcttttttcaagtctttcttcaagttctttccttgctttttctgttcctggatcagcctcatcctgagtacacattacagaactcatgctatcatatccatttatagtaatactataactcagtatctttgctcctcttgctgccacataagcttctgactgttctattgtttttggtattagcgataaattgtactccagccattgttttgtcttttcatctcccataacctctgacaaaagagagctgtttatatttacggaataatctttgcttcttaagcaatcatatttttgtgttaaatagttcttatattcatgggcattcttatatgttctgcccgttttgctgccagcattttgtgtgttgctataacgattcgtgtttgcagcataggtaacacctgtatcattttgaatcttcattatcctattatcctttccctgaaattttatttatctgttttttatatcgccctttcttcatttattatctactcaaatgtaacgaaccgaccttttttttgtaataaaaaaatcagcagacatatttcccactgattttgtaatcgtcatgctttctggtcgaaataaccattatacttccttatctatcttacctgacgttagagaggaatccgttttcaaatatgtaccattgtttgtataagtcacacttgcgcggtttgcagcatttgatataccagctgctttctgggctgttttgcctgcaaaggaattgtaacctgtaaaaaccgttttcaatgaactgatatctgctttcttcaatgcatcttcatccagctccagcttattcccctttcctatggtaatacctattttagaaagtaaatgactggttttgtctgtcatgcctgtcatccatgaagcatttctgaggacatcttttgtattggattctcctgcctccttaacaacgtcattataatcatcaataaaagctttcacttttttggtaattgcatcccagtcataatcctctacctctgtttcttccccggtcttttcatccttctttttaattttctttttttcccagagtgacgcatcgtttagtgcatctgctgattttttcagggaatccgcacttgttttcatcagtgtaagcttctgtgaagtatcgcctttccccgataatttttctgcatcctgctttgcataatatgctttcataagttttccatagcttccgtttttaattgcagcataatcagaaagcatattggtgtttcctacggatgaactgtcggaagttccgccaaataatgcggaataatctacattgctgttatatttacttgtgtaatcactaaaactcttaatctctgacataatcccattctcctttaccaactataagcgaatatcaatcggtgtatatactgcctgttgtgttgcattctgtgcattttccggagtcggtgtttctactgtcacctgtgtttcccttttgatatccgtattctttacgctgtctgtctcctctgctgctcctgtagctttctgtgttttctcagatttttcagtattattctttgttgctgtgccttctgtattgctgttatccgcttttgtagcttcttctactgatttatttgcatcagcaagtgtagacatctgtgctgctgtcgcagactgtgcctttgccttaagctctgccagttcttcttccttcttctcggtatttccttttccggcatcctgtttgatttcagattcaagcacactggcacgtccttctatctgtgttgccatactgccctgcacctttgcctgtttcatggaagaatctgcggagatcattgcctgcatacttgccttggacaatccggtgcctttctttttcgaagtgttatttgttccagccaccatatcatccatagatgacgaatttttactctgctgttcctttctctgctcgatctggtgctgtcttaactgctgattgagattgttaatctcctgctgtatctcctgacgctttttcatcttatcctctaatgacatttcttcattcgatgataagtcctgtagcttctgtttggcatttgcaatctgattctgaatatttttacttacagaatcattcccctgtgccattcccattgtccctgactgcatatttgtcccactaaatccattaattctcatttaatcctccttgttttgcggagcaaaatccgaacccactggtgaggagaggatttagactccttgttttgcggagcaaaatccgaacccactggtgaggagaggatttagactccttgttttgcggagcaaaatccgaacccactggtgaggagaggatttagactccttgttttgcggagcaaaatccgaacccactggtgaggagaggatttagactccttgaacttaaattctgaaatccgtttccttaaaaatctgtacaacatgatttctctttactgattccttcggcacatctttcttcacaataaacagcgatgttgtgaaccgccctttttttgttgtgaagcaaataaaaagcactaacttcttattgttagtgcctttcctgaaatactacttctttttattctacctgtaacataatacttagaaccacttcctgattctcctgctctaaagagatatctcccagatacatccttgcaacccttcggatattatgcagtccaattccatgctccttcccggatttctttgtttccggcagatcgctttccttatattttaatgtgccctcgtaactgttttttatagttatcataaaaatactgtttttccgaaaagacgtaatactgatataaggattttcaccactaacattctccatacaattgttaagtgcattgttcaaaatcacgctcaaatcaaatgcatttaatttcgtatccttcggataatgaaaatctgatgtaaaacgaatctgcctctccttcgcttctcttaacttttccatgaaaatcacatcaaggacaggactccccgtttttatctcaggagatatttcattccactcctttttcaaatgctccatatattctgctgcatcatccatatggttctctgccacaagatgttccagtatctgtatatgattccccatgtcatgacgcaggctgcggatatcctgatacagcttttccacttccccgatatgctttttcatatcactgacctgatttaataccagttcctgccctgtctgttcttcctgtgccaccttccagttttgaaacatgattgtcataacaagaattgctatgatagagataaaataatgcacgaagcttaaagctccataaaatccatacgtatcaatcaggctctttcctgtatccttttcataaatattcagataatattgcagaataccatatcctgttacacctacgagagaaggcatgatgagcattaccagctctttgccgctcatctcatcttttttgtatacataggctttattgatcagaccgattgcgactgcaaggaaaacgatgcagagcacaatatccagaattcttgttccagcataaagtccatattgcagccattgtcttccggcaatcgtattcccaaaaaccagagcttttgtgataaaatcatccagtctgcctgccattgcaaccgcaagccaacggatagaaaagaatgtcactgcaagaaatagtttctgatagatgtttcgtctgtcctgtacatacatcacaagaaatgcagccacaactcccatcaaatatgcagaaaaattgccaatccgctgcggtatcagatacagcacagacataattccaatataaacaatactgaccagagcagcttcccttttctttttcatatatgggtatacaaaaacaccaaaacagattcctgtaaaaatcaaaattgcaataacagaaaacttcgatgtgatcatccagcatctttccacgaaactcatctgacttcatttcctttcctctggttgtatttcagatacctcctgacaaactccggatagttctgttttgcaatcaatgcagttccatttttcatagtcacacaagttgcatcatatttttctacatatttaaaatgtacaaggtatgctctgtgtgttcggaagaaatcttccccagccatattctgcaaatcctgcagctttccgtagtattcaatatccgtatttcgtgtatggataataactttccggttaaacacctcagcatacacaatatcacgcaggaaaatttttatatggcttccggcggtctgtaccatgatatatttttcgtctttttcaagtctggaactcctttttacggcatggactgcctttgtcacaacctctttcaatttttcatcgtaaaatggcttcaccagataatgaaatgctccgacatcaaatgcctgaaaaacatactcctctgctgctgtcacaaaaatgagtatcatatcctcattgtcctgccgaagcatctttgccgtttccattccatccattcccggcatctgaatatccagaaatagaacatccggcttacagccacttgcaatcagtttctcacccgataaatatttctctataaccgcatccggcaataacttttttattttttcctccaatatctgaaccatagatacttcatcatcgcagatagcaattcgcatattgtcacttcctttttgtctgataaatatatttattatatcggacaaacagatggtctctgacacagttgttgtgaaatgacttttttttgttgtgaaaagggcagcaacccattattggttcactgccctgtcttctaatcatgtctgcaatattaaagaaatgaagcaaactcattcattggtatacgctgggattcatgtctatttgcatctgctttctcctctgtataaccaagcgccaatatattgattggttcaagtcccgacggaagatgaaattcctcttttatcacatctggtttaaaataacaaatccagacagaacccaaaccctgctctgtagctgtaagcatcatatgatcggtaataattgacgcatctatatctgttgttttcattccatcaaatgggcgcgtccatgctttattcgtgtctgcacacacgatgattgcaactggcgcattataaatgttagctgcctttgccagtttttccttcgcttcatcactttttacgatcaatagtctcacaggctgcatatttgctgcggttggtgctacatgagctgctttcaaaattgtctccaatgtttcctgtgaaatttctttatccagatagcttcttactgaaaaacgccgcttagcaatatctaaaatactcatttctgtaaaatctccttaaaattatgattgtattgtctagacaatttgattataatggattcgatataaaaaagacaagaacgtacttttttgtaatatactaaccaaaaagaaagtgtaaaacataaaatgcaaaatgtatataattgtcctgttgacgcaacaatctcaaaaattggaggcaaatataaagccgtaatcttatatcatcttggtagcgacacattgcggtataaccagattcggaaaaaaatcccagctatcacagacaaaatgcttgcccaacagttacgcgagcttgaaagtgataacttaatcatcaaaaaaatatatcctgtcattcctcccaaaacagaatacagcttaagtgaattgggcaagacactgattcctttattggactctatgtgcgaatggggacagcaatttatgcctgatgattaagaacccactgcaagagaccgtttcaagttttgtgtaaactacaaaagctgatataagatttgtgaatagttgcaaatgggcagagccgattttccaggttctgcccatatctgcattatacaggagtttttgggcatggcaataagacctgcctaaaacaagcttgttttacaggtttcgtccagccagacgttcttcaaaatagatctcaagctgggaatggatctgtccccagtcctgccggtgtcctgtccatttcttggtgatatccatagtcgcaagatacagcatttttaaaaggctgtcatccgatggaaaaacggtcttgcttttggttactttccgaagctgacggttgaagccttcaatcgcattggtggtataaatcagccgccttactgcctccgggtacttgaaatatgtggataatgtagcccagttatcatgccaggatttatagatcttggggtacttggaatcccatttatctttgaataattccaattcatttaatgccgtttcttccgttggagctgcatatacaagcttcagatcagccatcagttttttgatatctttgtaggaaacaaacttcgttgaattacggatctgatgaatgatacactgctggatttctgtttttggataaacagcttcaattgcttgtggaaatccatttagtccatccacacatgcaatcaggatatcctcaactccgcggttctttagtccattcatgatggagagccagaacttggcgctttcgttttctccaacatacataccaagaacgtccttttttccgttcatatcgatgccaagagcaatgtagactgcacgttttacaatgcgtccttcacttcggacatgatagtggatagcatccataaatacgacagcgtacacttcttccaacggacgttccttccattcttttacaattggaaggattttatccgtaatccggctgatggtactgtcagaaatatcaatatcatacagttcccgcatgtgagattcgatatctccggtagtcattccctttgcatacatggaaaggattttttcttccatgtcctgagtcacagtattctgatattttttgattagctgaggctcatactcaccgttacgatctcttggagtagctacatccatatctccatagcttgtgtgcatagttttgctagaatgcccattccgactgttatctgtttctttgtttcgatagtcatacttggaataacctaattcctcatccaattcctcatccaaagcaccttccagaagaacagacatcatgtcacgcatgatactgtttacatcggtgccgtctttgatgctgatatcattattcttcagataatcacgcatcatttctcgcattgctgctttttgtgggctgtcttttcttcttgccataaaaataacctccaaactgagtaattttatcttacatcagtttggaggtttacacaaactttgggatgctcccatatacacatgcatcctgtcattctataacacagcttgaacttctggcacttcttccaaatcggcgctttgccgggataacatcggcggggtgacatgaagctgctccgccgcccgtgtaatattctcctcccgcgcgatcgcaaggaagtcattcagcgctcgaagttccatattgatcccttctgcccggtttttctccggtagacggcacagaccagatatgcgattaccgctccgatcagcgctcctcccagtacgtccgtcggaaaatgtacgccgacatacagtcttgagaatgcaatcacaaacgcaaacaccagcaccggaacgccgatcttcctcggacccatgagaaatacgacgactgccaccgcaaatgcactccccgtatgcccggatgggaacgagtaatcgctctgcgcctctatgatcctgtgcagcccatccacgacctcgtagggtctcgtcctcgccaccagattcttcagcagtacgttgttcacaagcgtattgagcagcagtgaacaggtcatcaatccgccgaccttcctggtcttccgcagcagaaggaacagaatcgtcagcgcaatccaaaaataaccgtggtcgcccagatgtgtgagaaacgtgagtaccggcgtgaggaaatcattccgcatatgctcctgaatccacagaagcaccggtccttcccagtcaatcaaaaattgttccattgttatgtatcccctctttttctcttttgaggattcttattatagcacccgtctgcgccgcttacaagtgcgtttctttttgtgccttgcgccatcaccggacgtgctatctctgtgcggtcagcaccttattcaaaagatctgccaaaggcaccatcgcattcatcgcctcactcaccgtattggtctgcgctcccacctcaatcagcagtgttttcggacagtagtgcatattgtagcggtaccccttcaggtagatccttcgggtaaatcccggataatactccgccgcctttagctgcatctgaaacgagattgccagattatccgcaatataaggattgtagaggtaatcaatatcccccatcgccgtcgtcctgctcagcccgttaaaaaacatgacctgcgccatctgtattccgttgacctgcgtaaccagtcttgtactctccgccacgccgtcgcggtgcagatcaatgacaacctccaccccgggattttccgcaagcaccgcctcaagccccggtcctgccttggaataggcgtgatccctgtcccccacatcgtattctcccttgtggtgaatcacattgaatccatactgctctgtcaaaagctttgtcaggtaatccccgacaccgaccaccgacgtcgatgcatcccccggaacagaatctgcgtagccctcctgcgagtgcgtgtgatagatcaggatctgcggcgtcgatgcatcgtgtgacaggcgcagatcttttcccagcagtgcatcggcattcagctggctgctgttgattgtcgttgtgctgtccacctgataaaaattctgaatcagatagtcaaaatcattcagtttttcccgcggatataccaccaccttttctgtagccaatgccgtctgtatctgtgccgcctgtgctgtctgtgtctgtgccgcctgtgccgcctgtgtctccgcctgctgttccatctgtgcttccgcctgtgccgtctgtgcttccgcctgctgtccctccgcagcttccggtacggttccctgcgtctgctccttcgtctctccctcccgcatgcttgtactgctttgctccgccgcctcctgcgtcatgatgacttcccccgtcgccgcatccacatagttctcgtccgccgcctcccgcgccagaatagcctcgtaggaccagtcactctccacctgcgtctgataatcggcagatacaccactctcttccgggagcaaaaaaaagtgcgcgagaagccggtctgcaatcgtaagctccgccgtcccctgcgcctgcccgcaagcctgcggcaggaaaaatcccatgatctcctcctgcagcaaaaaccccagttctcccggttccagtcttacgccgccggataatatcactgccgccgccacaatcagtatggttaccggaaggattcgtctccgcttttttctcttatcatgacttctattataatttttatactggtatcgataaacatgcataatttactttatgcaccggcaatttcttttatgccgccaatctgccctccttaaagcgcatgcaggcacccgcccgcaaaagcgagattcagcccttccgagatggtgtagcagagtctcttgaccgactcgtcaatatccttcggcgtcacaaacatggcatttaaattcggcgacagcagttcgcggatgagttcatatttttccgcatcatttaatttttctaatgaatttcccatcgctgcaaacgcctggctctgtgtgagcgcggtaaccagattgtacatcgtatcgttcacgattgtcgcggcatcgaccacggtcggtacgccaatggaaatgaccggaacgccaagacttttttcatccagcgcatgtctgtgatttcccactccgcttcccggattgataccggtatccgtcacctggatcgtacggttcagccgtttcgtgctcctcgctgccagcgcatccaccgcgaccaccagatccggctttgtctcctttacaatgctgtgaatgatctcctgcgtctccatgccggtctgcgccatcacgcccggcacaatgctgctgatccggttcaccgtctgtttgccaaatgcatattttccatactctttcacaacatgccgcgtgataaacagattgtccaccactccaggtcccagtgcatctggcgtcacctcacgattcccaagtccggcaatcagcaccgagaggctctccttttgtaaccgcacaagctgtctgatcacccgcgcaagctgttcggatacctctctgtggtagtccttgtcctcctcatccatatctgccgcctcgatggtgatgtatgttcccttgggttttcccattgtctttgccccgttctccgtctcgatcacaaccgtgctgaccgtcaggttcgggctgagtttttcctccaggaaacggactcccttaagttccacatgatcttcctgcattttttcctgtgtctccaatgcaagatcggtgcgtatctgatacatagtctcctccattttttgtattcctgcagacaggacatttctttctgtctagtctgccacagaaaaaaaaagttatccgcaaatttttctgacaaatttcagcattttctcttgacaggtcactcaaaagagcctatactatcatagtatgtttacattgaactgtccgtgtccggcttcgatgtacatttcattgtaacgatgcactgcatgtgccgttaccagttagaatcataatcataacaaattggaggtgtacagattggctaacattaaatctgctaagaagagaattttagtaacagagacaagagctgcaagaaacaaatctatcagaagtgaagtaaagacagcaatcaagaaagttgaggctgctgttgctgctaacgataaggaagctgctaaggctgcccttacagtagctatttccacaattgagagcgcttcttccaagggcgtatatcacaagaacaacgctggtagaaaagtttcccgtttaacaaagcttgttaacacgctggcttaattccagagaatagatcttaacatacggtcctaacccaaccgtatgaaaaacaccagtaccgtcatactggtgtttttttattttttctgctttgccgcactgtagcggatgataaacagctccactgccatctgatcgttcatccgtcccgtctttaccgcttcctccagcgccacaccgtcctccaacgcctgtctcaactgccctgcgccaaaaccgcgcgcctgggtgagattccgctttacggcaaacggcggaatccccgccttctgtgccatcgtctgattgtcaaatcccttgcccgccatatcccgcagatgaagcagaatctggaactgtctggtaatcagatacatgatacgcatcggcggttccttgagtgtcagaaggtcataatacagatcgagcgccctgcgctggttgtgttccgcgatcgcattgaccatctcaaaaatgcggttcgtcgtctgctctgtcgcaatcgcttccacatccgcagcctcaatgacacttttgtccatggtataacagatcagcttttccagttcccggtcgatattgcccatatccgatcccgtcttactcaaaaaaagctgcatcaccgatcccgtaatattctttccctcttttttcaggcgcgccagcacccagcgcgtaatcagttcttccgtctgggtggcgaattccactatttttccggcgttcttcactgccttgtacatcctggaacgcttgtccacttcctcctccacaaacacgaaataggtgcttgcagcgggctgtgccagatactccgccagttcatcgcaggcatttttgaaaaaaccgctgttctcgataagaatgactctgcgctccgcaaaaaacggaagggtctccgcaagatcaataacctgcttcgggttgatgtcctttccctcgaagcggttaaaattcatatcgccgtctccgcccgacagcatgccgcccatcccggaatcctctcccgccgcagtgagcgcattctttaacttgtcccggtactggcgtttcaaataatcttccgttccatataataaatagatctgttttaaatttccggatctgatatcttcgtcaattgttttcataaaagtttctgtcctgttcttcctgtcttaaatagtttcagccgctccggcatcatatacatattatgctccggcaaaagtccgggcgtagcgcgttctgctgatctcgcagtgcacgtccaagaaatccctgatttcttggactgacgggcattcgccctatcattcgtcaaaaatatccgatgcattgtgcaagcactgcatcggatattttctccttatggcactgctcattgcttacgcacattatatcatacctttaccagtgccgcaaacttccctcactgccaccactgttctttttcctccagatacccctgacagacggcttgtccgtccgtctttttgacgcacagtctgccgctttccatcgtataatacacctggctccccgcctgctgcatatgcccgacagcctccttggaggggtgtccgtaccggtttgttctgctgcacgacaccagtgcgatctccggtgccagcgcctccagaaacccggtggaattggaatagcgcgatccgtgatgcgccgccttataaaaatcgattttctgcacgtcagctcccgtttttgtcttctgcagccaggtcagaatctcctcttcctgcgtcgctccgatatctccggtaaagacaccggcaaagtcatcctcctgataaaaaagcaccagcgactcctcgtttttgtccacagactgacccccaaacgcgtcctcagattcaccgggatgcagtgccgtaaacgttgcgtttccaaaatgccagatgtcgccccgcctcagccacaccacttttgttcccgcatcctctgccaacgcttccagttcctcccagttttcatcccgcggcatctgttccgccactgccagatactccacgggatatcccgacgacagtatctcccgcagtccgctgatgtggtcttcatcggtatgagacaccacccagcagtcaatctttttgacccctttgtactttagaaacggcagaatccgataagtgcccacctttccgacattggaacttcctccgtccacaaacaggtggtacccctccttcgtctgcagatagcaggcgtccccctgcccgacatccagcatatccagttccgcctccccgctccgcgaaactcccaatacggcaagcagcaatagtgcggcaaggaaaacgcccggatgtcctccattcttttgctctgccctcctgccgtgttccttttctctttccctttgctctctctgccggtgcaataagcatgttccaactcccagaaacgcataatataccgcgatctgccagcgctgcggtcttccgacaatccacatggcgcccggaagcataccggcaagcgcacatatatgcttccccataaagagcagaattctgcatggaaaaagcatcccttttgccaatggaagcgacaggagtcccaccattccgcctgccgctccgaatccgagcagcacccccatcatcggtagcatgagcaggttgacgaaaaccgcatagaccggaatctcataaaaataccatgccacaagcggcagtgtcgtaaaccagaccgctgatgccgcaaagatttttccgcgcagcgctcccatcccttttttctcataagagatgctctgaccgacccacacgacgccaaggattgcaacaaaggaaaagcggaatccggcgtcccagaacaggcagggatttttccagagaagcgccactgcggcaaatgcgagcgcacaaaatgtatcatagctcctcccgatgacctgtgctcccagaaacagcaggaacatgagaaccgcgcgtctcacggaaacgccccatccagccatcccgccgtatccgtacatcactcctgccgctgcaagggcagccatgccaaacggcagtcccgctttctttaacatccggtagagcgccatcccgatcacagagatatgaagtccggaaatcgccagaatgtgcgacaatcccccgatctggtagagtctcttcgtctctgcatccaaaaactccctatcgccgacgaccatcgtcgccagtatccccgcatcgcgctcgcccatcgtcttaaggtagacctctttaatccgctggccaagctgccagagggcttccgccgtctgcctctttgcacacacctttctatcaagtgccgaaccttccatcgcaaaatcaaatccgcgcgcaaaataataagccttcgcatcaaacgcaccctcatttgatgcccgcttccataatgtaatctctccgtgatatatgagaatatctccgatggaacaatcatcggaatcagaatagatcagaaccccaccgcacgataccggttctgcctgtaagaaatttgatgaatccgtccgaaacatacaggacgttaattcatagacatatcgatttttctgtacctgttttcccgcaagctgtccctgtacggtcacatacatgccatcctgcagttctcccagatacgcctgcctgctctcctccgcctccaaatatcttccgcttccaagagcaaacatcagcaaaaaaactccggcgccaaaagccgttctctttctttccgacggggaaatcccgtcgcccggacggtacccgtcagcaaaaatgccgccaagaattccgcaggccaggacgccgcaggctagcaatgcccgcgcgaatacgctccagccgtatgccgccgcaagaatccccgacagaacgcccgctgcgccaagacacaaaggccgttttgtcacacacttccccctttaatccgtttcggtaggttcctccgtttccgaaaaggcgctctctgcccccgtgacataatccatattgcggtcatacatatccgcgagcgggaaattgtcgcggtagactccgctcgtatcgccgttgacggaaatctgaaccttgctgatcgtggaaagctccgacagggaatccacgatcgaatagataacgattgcctcgtttactttgtaatcctgattcttgaacgcttcatccaggctgacgtagcagacgccgtccaccaccgacacagagacaagcttggttccctccggaatcgcagactttgcatccttggtcttcggaccgtctaaaagctgctccataatcagtttttccatggaaatattgctgctgtagtagacatcctcgcgcacttccttgaccagaccgtccccgtccagattggaaaaatacagcgtgagtgttgtattctgaatggaattgatctgctctcccggattttcgataaagctgtcctgattcatggtaccgacaagattccccttcgcatccgtaagcggtgcgtctccaatgtaaaatgccacgcagtccaccccgtcgatctgtgtcatcgtccggacaaccgccgctcggcacagtacctcatcgacagcactcattttgctgtaatcctcatcaaaatgcagggttaaaagcacaccgtccagtgaataattcgtgatttccacatcatttggaatcggcttccggtaatccacattgtccgaatccgaactcagtttcgcaaggaactccttgatcattccgtcggtatcggttgccgaaggctcataaggttcttccaccagacggttcttgtccttattcagatattcgatatgataggcactctgctccgtctgcctgccacacgccgcgagcgagcctgacaggaacatcagacatgccagtcccagacatattaacttttttctccatcgataagcttctcggctcatagactctcccttatctaagaaatataattcagcggaattctgacgttgaaaatcgttccctctcccacggtactgaacaccttgatggctccgcggtgcatcagaaccgcgctcctcgtaatggcaagtccaagtcccgttccgccaatctccctggaatgagacttgtccacacggtaaaaacgctcataaatatgctctaacgactcctccggaataccgattccgcaatcctccactttcagataaaaatactggtgatcggcattcaaagagacatgtacccatccgtccgggcggttatatttgactgcattttcgatcaggttggtaaaggcaagcgtaatctttacctcatccacatccgcactgaccggtcggaaactctccaacaccagctcgatattctgcttttccgcaatcggctttaagcgctttaaaatctgctctaacagttcgttgatgttgacattcgtgatgtttaaatctcccgcagacttatccatctttaccagagacagcagatcattgatgatcttcgtctcacggtccacctcgttgccgatatccgacatgaattcctgatacagctccaccggtgcgtcctccatgctgttgatggaatccgccagcaccttcatggaagtcagcggcgttttcagctcatgcgagacattggacacaaattcctgtctcgaatcatccaacaccttcatgcgccccaacatcttattgaacttttcacagatctgcctggtctcggtgtaagcgttaatctttaatgcgtcatccccatatcccgtctgaatctcctcgatcgactttgccatggcatggaacggcgccacaagatgaatcgcgataaacgttcccgcaaagatgatcgccacgatcgcaatcagttccatgacaagcgtattgcgcgccagatattccagattcagattgatgctgtcggtcgaaacgctcaccataatcacaccgatcgtccgcttgttctccgtctccgggtccacatgcaccaacggaatcgtcatttcaatgtaacggttctgggaatcatatttgctgatttcctccccctggatactcttgatcacttcctcggaaataatcgtctttccggtgtcaagattgtaggtatcctttatgatatggaactcctcatcgataatcatgacacgcccgtcatagatcgttgacagctgctctaactgcacgttgatcgcagactcactctccgcattattcagataatcattggaaacgatctgattggcgagaatcttcgcctggcttagaatctcactcgtgcggatcgacaccgcacgattttcataagagccgagcatcccggcacgcagcaggacgctcggtacaattccgatcagaatgcagagaagaatcagtctgcacttaagacttttgagaaaatcggttaattttttaaatttagacattgtgtacacccgttaattctgtgaataatagtacccgacgccccactttgtgtgaacgtatttcggttcgctcggattgctctcgatcttctcccgaagacgccgcacatgcacatccaccgttctgacatcccccggatactcatagccccatacaagattcaaaagattctctcttccatataccttgttgggattattcacgagcagttctaaaaggtcgaactcctttgcagtgagattgacctccctgccgagaataaacagccttctgctctcgcagtccagctttaagtctcccgcctcgatcaccttggattcttctttcctggactgcgatgcggcagttcttctcatgatggctttgattctcgccttcacttccagaatgttgaacggctttgtgatatagtcatccgcgccgtactccagtccaagaatcttatccatgtcatcgcccttggctgtgagcatgacaatcggcatattggaaaactcgcggatatgctggcacacctcgaatccgtccatcttcggcagcataatatccagcagaatcatgtcgtatgcattctctgtcgccatcttaagcgcttccttaccgtcgtaggcgcaatccacttccatgccgtcctgctccagactgaaacggattccctttacgattaacttttcatcatccaccacaagaacttttttcgccatttatttcacctttatctgatctctgatccgattatacaatccctctttgattccatctacattcataatctcttcaacggaagaaaatcctccgtgcgcatcccggtagtttacaaccgccttcgccttggtctgtccgatcccggaaagcgtcataagctctgccagcgacgccgtgttgagattcagacgtccgtcttccggagacgatgccgtccctcccgaagttccctcaccgttcctgacactgctgtccgcagaagtcacacttcctcccgcagaaactgcactgccgcccgcagaagtcatactgcccgtcatcccggccgcttcttcgctgtcaggaatatacaccatgagtccgtcgtacacgctctccgcaagattgactgcacacatcccggcatcctctgtcatgccgcccgccatctcgaccgcctcatagatgcggtctccgggctctaacacgtacacgcccggctctgccacctctccgcagacatagacataacattttcccgacgcacggtctgccttatcagcatcttccgtcgtctccggtgcaagagctgcctcagccgcccattcctcaccggaaacctccggcagatccacacttcccgtctgctccccgccggaaacgtccagtatatccagacgctccccagcctccgtttcttccgtctcctgcacattcccggtatcctgcgagacttccgtctccagataaacctcgttctgactgccacatcccgccataaaaatgcacagaatcatgccagcccctatcttcttccatgttcgtatcataagcattctccttcttctatataaaaggagtcctcaatgcccgatattcatattctaacgaaattttacagccgtgacaagagtgtttcagaaatatttcaaaattgtttcttccaatgttacccagaaatttttggcatccttggaatccggcattaaaactgccccctcatacgcgtccaacgccgtctgctccacggtatccggcgtctctgacggaatcacggagtaatgtcccgacaatccatgcaattcgtccgccatgccgactgtcacaaactgtgcaaaatctgccgccgctgcactgtcttttgtataatcattgaccactatcatatcggtagacgcacatgtcgccgccgagagcgtatcgcttaactccggcatctgcatcagcccatagtcatatccgtccagctgccagagtgtatcagtatccaggattgccgaaagagtccgcccttcccggaaattgttcacgatatgctgttcggacacctgatccgcatcaatggaaaaagatgccaatatcgtgtcaaaatactccagatccagctgatagagcgtatcatcgtaggtgacatccaattcgtccgatcctctctttgcgaacgtgacgctgttgccgacaaacgggaaatcatagaacgcatccttgacatcccactccagcagatattccacattctctgccggctcgttctcattggaataatcgatgattgcctgcagtgatgccggcgcctcggtaaaataatccgtctggtaaataaacacgcacgcatcgtaggacagcggatacccgagcacgcgctcttcgtaggtcgccgcctcgactgccttttccaacacgccgttttccgacggatccgtctgattcacggaaacaagaccatagaggtatgcttcctccagattatcccccggtaagaggtacacatccggaaatgcatcatcctgcatggtcttatcgtaaatagttccaagataatcaatggtatcctgatactgcacggctacttttttcccggtcttagcgtaatagcgcacagccgcctcggtaaaaaagtctgcatagctgtcatccgcataccacagcgtaaggtctgccggtgcgctccggtaagcttcatccgccgccgtttctcccgtctccgtggaggacacaccctccccactgctgccgcatccagctgtattcataacagccattcctgtcattccaagcacaacgacaagtcctgccaccgtcagtcttttgtataatcgtttcattttatttccctaatccgtttttttattctcattatcagggaattacatctctgccagaaccgcatccagcttctctgccatctcatccacatgctctttcccgataatcagtggaggtacaaaacgaagcacatcggcgcctgccgtgatcacgacaagtccgtgttccaatgctgctgacgcaatttttccaaccggtttctcacacacaacgccctgcatcagtcccagacctctgcgcgccgtaaggaaatcatacttttccacaagcgcatccagcttctgctccagatacggcgtgatctcttttacatgctctgtaatccgatcccgctccatcatcttaagcacggtgtcaactgctgctccgacaaacgggttgccgccgtaggtcgtcccgtgatcgcccggtgccagcgacttttccgccacgcgctcagtcatcaggaatgctcccaccggaacaccgcatccaagcgccttcgcgctggtcataatgtccggtttcacaccgtagtgctgccatgcgaacatctcgccggtgcgccccatgccgcactggatctcatctaagatcagcagaatgtcatgctcatcgcagagtgcacgcaccccctgaaggaattcgtcggttgccgggtagattccaccctcgccctgtaccgtctccaaaataatagcacaggttttctcatttatcaaagcttttacgctgtctaactgattaaattccgcgaaacggattcccgggatcagcggttcaaacggttcctggtaatgtttattgccggttaccgagagtgctccgagacttctgccatggaacgagtgattcatggcaatgatctcatgccctgcatgaccgtccctggtgtacgcgtatttctttgcggcttttaaggctccctcgattgcctccgtgccactgttcgtaaaaaagacgcgatccatccggcttgcctttaagacacgtttcgccgcgcttgtgatcggctcgttgtaaaacaggttggacgtgtgcatcagcttatccacctgcgtctttagcgcctcgctgtactccctgttatgatacccaaatgcctgcacggcgattcccgccgcaaaatccagatattcttttccgtccgtgtcatacaggtatacaccctccccatggtcaaacaccaccgggaaacggttataggtatggaggatgctctcctccgcctctttcatgcatgtctctttattcattgtaatacctcttctctttctcactaaggatcgccgtaccgatacctctgttggtaaagatctcaaggagcagacaatgtgcgatccgcccgtctaaaatatgtactctggacacgccgttttcaatggcgtcgatgcagttgttcagtttcggcagcataccgcccccgataaagccgtcgccgatcaatgctctcgcctcgtcgatggtcagttccgagatgagcgtgctcttgtccgaaggatccttgtatacaccctcaatgtccgtcaaaaatgcaagcttctccgcgctgaccgcctttgcaatcgcacaagccgcatcatccgcgttgatattgtagctgttgtaggcatcatccattccgaccggacacacgatcggcagaaaatccttctccagaagatcgtagaggatcttcggattgacctccgtgatctcaccgacaaatccgatgtcctccccgttggaatattttttctccaccttgagcagtccgccgtccttgccgctgatgccgattgcattgacacccagctcttccaccagcttgaccagagatttgttgaccttatttaagaccatctccgcaatctccatcgtcgcctcatccgtcttgcggagtccgttgacaaacaccggctccatgccgacttttccaacccagcggctgatctccttgcctccgccgtgcacgatgatcggcttgaatccaaccagttttaagagggtcacatcctggatcacatggcgctttaactcctcgtccaccatggcgcttccgccgtactttaccacaatgatcttgcggttaaaacgctgtatataagggagcgcctcgatcagcacttccgcctttgccagaatttcctgcatatttttctcgtccattttctctccactctccctgaatttttacgtctctgcttaggaacggtaatccgcgttgatcttgacataatcatatgtcagatcacagccccacgccgtcgcctcctccgtgcccatcttgatatccgcgatcgccgtcacctccggctccgagaggatcttcgtcgcctcctcctcgctgtagtcaagtgccacgccgtcctttatgatctgcatttttcctgccgcactctcaaagaacagatccaccttctccggatcaaactgtgcgcccgagtaacccatcgcacagagaattcttccccagtttgcatcgtgtccgtagattgccgccttggtcagattcgatgtgatgaccgacttgctgatgatcttcgcctgctccttcgtctctgctccgatgaccttcacctcaaacagcgccgtggctccctcgccgtcgcctgccatctgcttcgccagatattcattgactgtccgcaatgcctcgcagaacctgtcgtaatcctcatttttctctgaaatgaccggattctccgccatcccgttcgctaaaagcagacaggtatcattggtggaagtgtcgccgtccacggagatcatattataggtgtcgcagacatctgcctgcagcgcttctaaaagcaggggctgtgcgatcgccgcatccgttgtcacaaaactcaacatcgtgcacatgttcggatgaatcatgcccgagcctttgcacatgccgccgatcgtaacaggaacgccgccaagcatgacttccaccgcaatctccttctcgtgggtatccgtcgtcatgatcgcctgtgccgccgcatgaccgctctctgtctcacccgacaatgccggaaccatcgcctcaattcccgcacagatgcgctccatcggaagctgcatgccgatcactccggtcgatgccacgagcacctgatcttccggaaccggaagcagttcaccgactttctccgccgtctgtctgcagtagcgcattccctcctcgccggtacacgcattggcaatccccgcattgatcacaaccgcctgcgcctttttgctctcgtatacaatcttctgatcccactttaccggggcagccttcaccagattcgtggtaaaagttcccgccaccgcacagggaacctcgctgtagagcattgccatgtcctgtctgttctgatatttgataccagccgccgtgctggcagcacaaaatccttttgcggcggtcactccgccctttatcatctttatcattccgcactccttttcttcctatggattataggtcgtgatattatcctcgtttgtgacatattcgtaatagttgacatcctcgcggaaagtccacccgagtccctgccagaaacggtttccgacttcatttttcttgaatgcaatcaggttgatcttgttgatatgctctgccgcaagcgcatccacgcaggcacccacgagtttctgtccgatcccgtgcttgcggtacgcctcctgcacgcatacatgatacaggcagcctcttctcccgtcatgtccgcagagaatcgcgcccacaatctttccctccgccaccgctaccatgctggtggtcggattacgtcttataaaacgctccacgccctctctggaatcatcgatgctgcggattccaaacccgtgaatctccatccataacgcatgtaccgtctcaaaatcatccattgtcatcacgcggatgaccggttctgtctctttcatacttccatctcttctctttatcatttccggttcattttcccgctgcttccttccgtggaaaatccttcccgggttctgttttcgctctgtatctacgggaacatcggcaccagacaaagcccttccgcctcgtcaaatccaaacagcagattcatgttctgcactgcctgtccggccgcacccttgaccagattgtcaagcgctcccatcatcacgattctgcccgtgcgctcatcgatcttaaaaccgatatccacataattgcttccctcgacccatttggtctccgggcacgcatccttcggaagcacgcggacgaacttttccttcgcataatacttatcgtaagccgccttgatctcctcgtaagaaggaagacttccgtccgcctttttcgtcagggtggcatattctgtcgccagaattccgcggttcatcggcaccagatgcggcgtaaaattcacaacaaccggtctgcctgccgcgtagccgagctgctcttcaatctccggtgtatgtctgtggctcgtgacaccgtacgccttcatattctcattgacctcacagaacagattcggcagcttcgcaccgcgccctgcgccggaggtaccggacttcgcatcaatgataagggtatccggatcgatcagcccttccttcaccagcggatatgccgtcagaatcgaacaggtggtgtagcagcccggattggcaaccagtctggcatttttcactttatcgcggttcacttcgcaaaggccgtacaccgcctccccgataaactgcgggctcttatgctcgatcttataccatttctcatacaccgcaacgtccttgatacggaaatccgcggacagatcgatgatctttgtcttctcaagaagtccttcgtttaagacgcctgccagaaatccctgcggcgtcgccgtaaagatcacatccacctgctctgccagtgcttccatattgtcgtccatacacacgtcatccacgatctcaaacatgttctgatatacttctgcgtatttctgatctatataacttctggaaccgtaccatttgatttccacttctttatgtcccatcagaagacgcaccagctcatttcccgcataaccggtcgcacctatgattcctgcctttatcatgttcgtattccgcctttccttttcctgcaaaaaatcttttcacactatatccctatattagtctacctctttgccatagtaaagtattttttgtccgttttttagaaatattcttgcataattatacatccgttttttcttttatgcaagcattgttttactatttatgcaacgtttttcttgttttagatttcttttttccttaatttatataggttttccctattttcattctgtatgctttgtacatgtatatgcatttttatttgaaatatatgtatattttttcacttgcttttccgttgcatatgttgtatattgattgcagttaatgatttacagaaaggaaaaaagcccatgaaagaaaaagttatcttagcttactccggcggtctggacaccaccgccatcattccctggttaaaggagaattacgattacgaagtcatctgctgctgcatcgactgcggtcaggaggaagaactggacggtctggaagaaagagccatctcctgcggagcttccaagctttacatcgtcgacatcatcgacgagttctgcgatgactacatcatgccgtgcgtacaggcaaacgccatctacgagaacaaatatctgctcggcacttccatggcacgtccgttaatcggcaagaagctggttgagatcgcaagaaaagaaggtgctaccgccatctgccacggcgctaccggaaaaggaaacgaccagatccgttttgagcttgccatcaaggctctcgctccggatctcaagattatcgctgcatggagagacgacaagtggaccatgcagtcccgcgaggatgagatcgcatactgccaggcacacggcattcatcttccgttctccgcagacaccagctacagccgtgaccgcaacatctggcatatcagccacgagggtcttgagctcgaggatcctgcctgtgagccgaactacgatcaccttctggtactcggcgtctccccggaaaaagctcctgaggagggcgagtatgtgaccatgaccttcgagaaaggtgttccgacctccgtcaacggcaagaagatgaaggtttccgatattatccgtgagttgaaccgtctcggcggcaaacacggcgtcggcatcatcgacatcgtggagaaccgtgttgtcggcatgaagtcccgcggtgtctatgagactcctggcggaaccattctgatggaagcacatcagcagctcgaggagctggtacttgaccgtgctaccatggaagtgaaaaaggatatgggcaacaagctcgctcagatcgtatacgagggcaaatggtacacccctctctgcgacgcagtgaaagcatttgtcacctccacacaggaatatgtgaccggtgaagtcaagttcaagctttacaagggcaacatcatcaaggccggaacgacctccccgtattctctctacagcgagtccttggcaagcttcaccaccggcgatctctacgatcaccacgatgcttccggattcatcacactgttcggactgccgttaaaagttcgtgcaatgaagatgcaggaaatcggcgagaaaaacaaatacgaataaatcgtacatccggattgcttacacaagaacccccggaaatctgccgtttcggcagatttccgggggttccttttctgtccggttattcacattccgataattttcttcctgatcatgcgctttcctgcgcatccagtatcgcatccagcacggcaagccccatctggatctcctgctcggtcaggctgccatatccaagcagcagcaccggacattttctgtcactgccattctctttcgtcagcgcatattcgccgagccccgatactttcacgccctgcgcagccgcacgctcacagatctccctctcgctgcatccggtatctgcctccacgagcacatggagtcccgcatggtctccgctgactgagagcacccagcttctttttttcagttcaccgatcaggaaatcatgcctgccgcggtaaataccgcgcatcttattaagatgccgctcaaaatgcccgtcccgcaagaactcccggagaatctcctgctgcatgcgcggcaccgtcgtcgaataaaatccgcagacggcgcggtagcgctccatcagctgctgtggcagcaccatatagctgatacgcagagacggcgcgatgcttttggaaaatgtcccaaggtaaatcacctttccaagtccatccacgctctgcagcgatggaatcggctttccgcggtagcggtactcgctgtcatgatcgtcctcgatcagatagcgctcctcccgctctgccgcccacgcaagaagttcaagtctccttccaagaggcatgacgctgccggtcggaaactgatgtgatggcatcatatagaccagttccggctctacggcgcgcaccgtaccgccgctaagcccctgctcgtccgctggcaccgtcaccacccggtatcccatattccgaaacgtgtggtatgcctgcggatatcctgggttctccatgagcacagtcttatttttcccaagaagctgcgtaagcagaatctccagatactcattaccggctccgagcacaatgttttccgggcggcagttcacacctctggcgtgatgcagatagtccgcaatctcactgcgcaggctgtactccccctgtccgtcccccgccatcagcagttcctcgctgtcatccaacagcacattccggctgatcttccgccagacgttgtacggaaaactgcgggtatcaatcgcatacggggaaaaatcaaccagacagaccggtttttccgctctgtgtacccgtcccgtttctccagcgctgtttccctgaagccggtacagctccgcgatgtcgcatacaaaaaaaccccggcagggttccgcttgtatatatccctctgccaggagctgatcgtatgccatctctacggtgcttctgctcactgcaagattcttcgccagaagacgcgtggacggcagccgttcccctctcggaatcctgccgtctgtaatctcactcttgatgtattcgtatattttctcatagaggggagctttcgctcccccctgtaagttcatcataatctctatcattataaaaccttatccgtcgttatgccttgcttctcttgatctcctcgacaatgcgctccttgagttcatacgcgcggtccttcatcttcttggacgccgctgcggactgcaggattcttgcaatgcacttcgatgcaacatcgtactttttgtagtggtatgccatcgtcgcgagcaggtaatccatcgtgcactcatccatgccgcacatcggataggtctctgtggataccgcctttgtaaatccttcatacgcctgtgcatagaacgcctcttcctgctccctgcactccttgatctgctctgccatcttcggatccttcgcgtctaaagactcacgcttgccgcgcagcagccatgcaagattcaggcaggtgtacgccttctcgctgttctttccttttttcacaatcgtgttgaacagtgccagcttgtagcgctcgatcgcggtatcataatcgatcagcgtcggctccacattgtccgccggcttgaaattcacgcagatcttctccttgatcatcttgacctgcatggaggacaggtgttcaaaatagcgcgtaatcgcggtataaccgcagtacggacaggaaatcacactgtactttaaggtgtcgatgtgctcatagcgcgggcgcagatccatatcggactcaagacgctttaatcttccactcttgatcatctttgtcttaaataccttgtcacacactgcacaacgcacagccttgtccagaagaaagctttcttctgtcggcgccgcctcctgctttgtgccgtcctctcccacgacttctttcttctcttccgcaaaaagattcgtggtatcctctgcctttaaaccaaatttttccaaaccggataataaattcatatctattcctcctaaatctcagaccgcgtcctacgcagttggcagcttgaatgaactcttcagtgacacaatgcggttgaacaccagctgctccggcgtcgaatcctttgcatccacacagaagaatccctggcgtacaaactggaaactgtcgtaagcctttgccccagcaagattctcctccaccatacagttctttaacacagtcagtgaattcggattgaggttcagacttccatcctcattgtatacccctttttcctcgtccacgatattctcatacagtctgaccgttgcaggaaccgcatgtgctgcggatacccagtgaatcgtaccttttacctttctgccatccgggctgttgccgccgcgggacgccggatcgtaagtacaatggatcaccgtcacgttgccgtctgcatccttctcaaagctgttgcaggttacaaaatatgcattcatcaggcgcacttcattgcccgggaacatacggaaatactttttcggtggctcctccatgaagtcttcacgctcgatatagagttctcttgagaacggaatcttacgtgaaccgagcgcctcattctccagattattcacaacgtccagatactcagtctgtccttccggatagttgtcaatcacaaccttcaccggatcaaggactgccatcatacgggacttcttcatcttgagatcctcgcggatgcagtactctaacattgcatagtcaacggaactgtttgcctttgaaataccgcacagttccacgaacatctttaacgattccggtgtaaatcctcttctgcgcagcgctgcgatggataccagacgcggatcatcccatccgtccacaataccttcctcaaccaggcgcttgatgtaacgcttgccggttaccacgttggtcagatacagctttgcaaactcaatctgtctcggcggcatctcatccttatccggaataatctgtgcgcccacctcgttgatgacccactcataaagtggcctgtgatcctcaaactccagcgtacagatggaatgcgtgattccctcgatcgcatcctcgagcggatgtgcaaaatcatacatcggatagatgcaccatttatcgccggttctgtggtgtgtcatatgcgccacacggtaaatgaccggatctctcatattgatgttggaagaactcatatcgatgcgtgcgcggagcactttctcaccatccgcgtactttccttcccgcatctcctcaaacagctttaagttctccttgacacttctgccgctgtacggatcttccttgcccggctccgtcagagttcctcggtactcacggatctgctccgcagacagatcggagacataagcttttccttttttaatcagctctacggcacactcatacatctgatcgaaataatcggatgcgaagaaaagtctgccttcccagtccgcgccaagccacttgatgtcctccgtgatcgcctccacgaactcggtcttctccttggtaggatttgtatcatcaaatctcagattaaactttccgccatacttctgtgccagaccataattcaaaagaatggacttcgcatggccgatatgcagatagccattcggttccggtggaaatctggtatgaacaaccttgcagtgcccttcctcgatgtccttatcaatcatctgctcaataaaattctttgagacattttcgttttccataatgtcgcatcctcctcaattacaatccggacagcctgccgtccgatctgctttccctgtcaaaaaaagagaaagcaactcatgaaatatcatacatgatacaccgtcaaggtgcaagtataatataacatgaattgcctttatttgctaatactattttatttctatgtttttactgatcttccaccagtctatcccacactgtataagcagcatttccacgatgatctgtcaaaccatacctttccttcagaaaagtccccagatattttgataccttcgtggcgccggcttcattcaggtgatctcccccatcaagtgtgtcagacttccagtcgatcccgagttcttctgcatacaaattcagatccagatatagcacatcatgctcctgtgcatattctgttaccgcatcatggcgtgatccgttccagctctgtggagacggaatacttaccagcatcatctgaatgttatttttttcacaaagtctgtgcactgcgtcaagatagctttccggtacaaaagccagaggctcctttgccgattccgtctgcatatagtcaccacctgtgtaaggcactatcgctgtctttttctcatatcccatcgtaaaatcgggcttcggttcctccggctgcctgctccagtctgactcatccatattcttccagcggttgtgatatttataaaacggaagatcacttgcaagctgcagctcgagcgcatgattaagctgatctgccatactgccatccatatagatcagattcgtctctaatacaacaatatccggagactgcttctccagaatctgtttcagccagttatacgcttccggtataatctgaccggactgcccgcacacatacgacgcaatcccctgctcttcccatatctgcaccggttttatcgatgtaaacgtgatactgtctccaaagaaaataacgtccagcgaattgttctctgccccaaagattccgttgacctttacatcacgcggcggcattcccgcctctactgaattatcctttggatagaagacccgtgacaatcccagaaaaatcactgcaagtatcccaaaaaacaaaagataccttactattttcttcactctgttcatctgatcctcctaaaaattcgcatagatcaactccacttccagatatccgtctccgaaggccccaaagataagtggaagcaggatcattacataataacaacaccaacgtgccggtgtcggcagtgtgacaatcttccgccggatagagatcccccgctcatggagcagccccaccacagttaccagtataacaccacacaaaacgatcgcgatatctgccctatcaatcccgaaagacggcagatccatctgtcccaaagccgtcatgtgggaatgtccgaatacggtctttagcataacaatcgcagcttttgccccgtttgcccgaaagatcatctcaccgatcaccaccagcacactggtacgcacgatctgaaaaactgcataccccttacttttcaccagtctgccgcatttttcatagaataccgcaatcagcggttcacaaagaattcctgccataatcagaacgaagtaatacataccgaaaaaaatataattccagtgctgcccgtgccacagtccattgagcagccataccggaaaaagagcagctgcggataccgctactttagcgccatgctttccaaaccgcgccttagctctggttccaagcttctgtacccatccggtaagggataccggataaaaaatatagtctttcagccacgcgccaagtgtgatatgccatctgcgccagaattctgatacattttttgacagaaatggctgcctgaaattttccggcagcacaacaccaaacatctctgccacgccaatcacaatatccatacatcctgaaaattcattgtaaagctgcacggtatatgccactgcggcaagagccagaattgcaccatcatagctctggtaattcaaaaaggcaactcctactgcccgatccagccggtctgcaatcacaatctttttaaataatccccacagtacacgctgcgcacccatggtaagattttcgctgctaattgctgttcccttccacagctgatccgccgtctgatcaaaccggctgatcggtccctccatgatttgtgggaaaaatgccatgtacaacgcaacctttccaaactgtcgttcagccctgttcttcccctcatagatatctaccacatagctgaccgcctgcagtgtgtaaaaggaaatacctatcggctgtagaaaccgaatactcttcaggcagataggcaaggtcagaaggcgaaatactgctgaaagattctccgcgaaaaaattataatacttcacgataaacagtaccccgaccagaagcacaagactgccgcaaagtactgcccgcttttttccggtaaacttttttttgagctgctttacctcactgcgtgcaagcccatttttcttttctttgaactcctgtccgatgtgatcgatccagagtcctgccgcatacatgataaccgtcgccccaaacagatacagtagaagtatcccactgaaagaagcaaaaaaaatgtatcctgccgccagcagcacatacggacggtattttgttccggcaatctggtaacagatcagaatgagtggcagaaataccagcagaaacagcattgtatgatatgccatatcagccttcttcctccagtctctgtatcattgcccagatagcttctgcagaattaaagttctttgcaatcatatctcctggtgcgatctgcacatcaaatgtatccccgatctctgataccagcgagaggattgcaaacgaatccagcaaatgatcatcaatcagtgttgtacatgtactataatccacatccggattaatctcctctaaaatctccaataattcttccattcttcatttctccctctttataaaattctatctgccgctttattaagcggataaaccggcattctgctccgcagcacccgaaagccctccgtcttgcagtagcttaccaccgccggaagatcccggcttaaaaaaagtgacattccctccgtcatggaatacgcacccgtgcgctcaaataccagaagatcccccgggcgaacaccttttaaaggatactggcggatcagaatatcatttgccgtgcagagtgcaccacagatgcagtaattctgctcttcttccccctcacgtgcaaaaagcggcgtgcagaacggtgttttcatcgccataacctgtccatcgtagttcaggtgatgcatgccagcatccaccagacaatacctcgtcccctgattctcctttacttcccgcacttttgtgacaaagctgccacacattgctgcaaggaatcttcccatctcaaatgtgaccgttcccggaaaatgaagttctgtgacacagtccgccgcatcagaaagcatcgccagtgcctcttctcttccccatttctttgtacctttaaagtactccacgccaaatccaggtccatattcgagccgcggcactttaagaccaaaccgttcccagatcctgtcacatacctccgcgagctgtcccagttccttgcggatctgttcactttttctcttctgcgttcccgagaaaaaatggatccctgcgaactgcacatacttctgctgtagaatcttatcgaccgactcaagcaaaacgtcctcatccattccaaactgatttccactcgtaagacgcagcaacagctccacatttcgtccatattctctggatagacacaaaaaaagatctacctgatccattgattctgccgtaaaatgcggcaacttctccttttccagaagttccctgatatcctgttcttcttttaatacgccggaaagaatcatcttctctgccggaattttctgctcgatacagatccgcagttcccccggagaacagacttcaatatagtccgtcatttctgccatatcctctgtcagaaatggatttgccttcatcgcaaaacaaagtcccacacggtctgcaagtaatgtcttcatttccgcgacatcctctctcagacgatcgaggtcaaacacgtagcagggagtctgaaattctccggcagcttctgccagcacttcctgtctcatcttctcttctcctccctgtaatgattccagagagccgcgcggtcaatttttccattctttgtcatcggcatctcatccatatgtaaaaacttatccggcagcataaacgccggcatctgttcctttacttttcgacgcaactcttttttatcgatctctccaacgtaaaatgccaccagtttctgctcctgctccccgtagatacagcaactgcgtgtcacaccttccgtctgatccaatgtcaactgaatctcctccagctcaatgcggtgtcccatacgcttaacctgaaaatccctgcgtcctgcaaaacacagcagcccctcatcattataagtaccgatatctcctgtgcggtagattacctgcggataactctgattctctggattctgtacaaagctcttctccgtcgcctgtggattattgtaatacccacttgccagggaagtgcccgccacgcagatctcgccctgtatcccggcatctctgatcacacagttctgatcatccaacagaaataccagacgattgccaaacgcacttccgatcggaagtgccgcatcctccggttcatcgcctcttacccggtaataggtacagttacacacaatctccgtaggtccatacagattgacaaactctgccgccggcagtgcctcccgccaggctttcagatgcttatatggcatcacttccccgctgaaaagcacccggcgtacctccgacggcacacggtactcaaatccgcgcagtgtcgtcaccatgcaaagtgcggaaaccgcccaggtcagagatgtcacatgcttctcacacaggaaatccagaagcgatggcggcatggaaaacatctgctttgggatcagaacaagctttgctcccgtaaaaatggatgtatatatatccttcaccgacacatcaaaatcaaacggagcctgattgccgatcacatcacactccgagaaatcaaacgttttcgcaaactgctcgataaaatcaaccaccgcacgctgatttacaatcactccttttggcatccctgtggatcccgatgtaaaaatcccatataagagatcctgatccaaactctgtgctctcacccggtccaacgacacagaatcaatgtcagtctgctttgccgcttcgattggaaccatatttccctgatagccacatgcacgcatcttctcctcatactgcacatccagaatcatctgatccgtctgtagtgtggcgagaattttttcaatccgcacattaggatattccggattaatcagcacataaaatgcccctgcatatacaactcccagaaatgcagccagggtatctgctgatttatccatcacgacagcgacaggctttcgtatgacgtgtttcctgcataaagctgacccgatgcgttgcgcaagctccagcagttctccccacgtgtaagaaacgctcccgtcatcgaccgccgcccgctctttatacctgcttaccgtcgcttccaaacgatccaacacacaattcaattttctgtcctctactttccctgttcctgccgcttcttatctgtcaagatacttcttcacctgttcctccaggaactccggtgtatcaaaataatcaatcttcatggcatgctttacttcagaaagtgtctttgcagccgcttcctttgccacttcgcttcccgcctttaaaatatcatacacatcgccgatgcgctgctcgtattcctttctgcgcgcacggatcggagacaactcctcctgcatgacgttattcaggaacttcttcaccttgacatcgcctaggccaccgcgtttgtaatgtgccttgagctcatccaggttcgcatactctggcagatactccacgaagtgctcgtccgtacagaatgcatccagataggtaaatacggtattgccctcgagctttcccggatcttcgatccggatgtgatccgggtccgtgaacatggacataatcttcttcttcacatctgcctcgctctccgagagatagatgcagttgccgagcgacttgctcattttggcctttccgtcggtacctggaagtcttaagcaggccttgttatccgggagtaaaatctgcgggtctgtgagcgtctcgccatacaccgcattaaacttatgtacaatctccttggtctgctcaagcatcggcatctgatcctcgccgaccggaaccgtcgtcgcatggaatgccgtaatgtccgccgcctggctgatcggataattgaaaaatccgaccggaatgctcgcctcgaagttgcgcatctgaatctccgccttaaccgtcgggttgcgctgtaatctggagaccgtaaccagattctggtaatagaaggtcagctccgtcagctccgtcacgtaggactggataaaaatatgagacttcgccggatcgattccgaccgaaaggtagtcgagcgccacctccataatattgtcgcgcacctttgcgggattgtcggcgttgtccgtcaatgcctgtgcgtccgcaatcataataaaaatcttatcaaacgttcccgaattctgaagttccactctccgcttcagagaacccacataatgtcccacatgcagcttgccggtaggacggtcgcctgtcaaaataatcttttctgccattgtcatttcccctgtcaaacatattcttgctctattatacatgttttgcgggacaagttcaatttttcttttgacaatccccggaaagtttttcagaaaaatagccgtcgctgtaaagttttttcaaaaacgatgccagaagcggcactccgaacagtccaaggattccgaaaaagtgaagccctagaatcatgcacggcagcatcacaaccggcgagagccccatctgttttcccaccagcttcggttccacaatgttgcgcaccaccgtgatgatcagatacagccccatgaccccgattcccattctggcattgccgccggcaaacgcaatcaccgcccacggaagcagcacggttcccgtgccgagcaccggcagaatatctaacaccgcgatcagaaacgcaatcgcgaaagcaccctcgatctgcagaagaagcagacctgccgcaagttccgcaaacgtcatcaaaaagatgaaaacgtacgccgccacacattttcccatcgttccgaaggttccctttttgacggcagacaccgtctccttccatttttccggtatgatcttttcgaggaaatgcatgatctgtgggaaatccagttccatgaacaccgtcgatatgaccgcgagcagcaatttaaagcacatccccggaatattcaccgcaatgccggagacctgctgcagcagggtgccggacattccggtcagaagctcccctgcccggctgaccgcctccgccgactccgtacccgccgtccgcagcacctctcctcccaccgtctctccagtcaaacctgccgtccacgcgcagaaatgcttcatcatcggaaaaatcgtctccgagacaaaccgcaccacttccccgagcagttcctgtcccaaaagcatgatgcggtttccaaggaatccgatcaccagtcccgccagtccgtaaaacagcagaacgaccgtcaccgctgcaatcctgcgccttatatgcatgcgctctgtcgcaaacgccaccggaaacgaaagaatccacgccacaaaaaatgccgcaataaacggtaggagcaccggtccgatcatttttaccgccgcgaggacaagtccaccccacaccgcccagtatgcaaacttaataaggaattctttctgatgtctgatccgctcttcccgctccatggcaatcctccgcgtcatgttttctcctaataactatatccaccgggaagcgattccatgcacgacgtccgcacattcctttccagaaaaggaactgccgcaataagcatatcgcactttgctttgataagtaatattattagaagccagaggacaaaaaagttccagaataaacagacggcggcaaattctttgaagcaaaattcacgtatttcttccatgccgtggttggcatcccattccgtgtctcttccacgtttgaacactcccggaatgtgtccgacaagccgcagacaatgagcggactttctggtgtccctaatggcacctcttcacagacaatataaaaccgcgcgaaccgaactcgccggcatctgctattgaaaatagggcagatgcgactcagacagcggcttcgcgcggttatgttttgttcagaggtgaccataagggacacacacaaaagttctaaaattgtctgctggcctgcggacacagtccgtggagtgctccaaacttggaaagacatggatcatcacggatgccagctgcggcatggttagaaataccggattttgcggtcagaatttgccgccgcatgtttatctggaacttttaagtatctatttcttgtaatattacttatcgcccaaagagctctatgcttattgcggcaattcctgattcgcactttattttgttattccgcctccagcttcagcatatagatgcagttcggtttgtctaccttcaccggggaaccggtctcaagcgaataaccatccttgtaatcgatcgtgtagttgaaaatgtcgttggaattgttgttcaatgtcagataatgcttctcgtccggatagatggcaagcatcttcggataatcactgttcaccttcgtcgtaaataccggggtaagcattcccgtcttctcctcgatctcatagcacacgacagagttcacgcctgcgttgctgcagaacagatacttaccgctcttcgagatctccatacccgatgctgcacagatatcttcctccttcttcggggaagtgctgatggtctggatcttctcaaataccggctcattatcctgcacagaataatgatatacctccacaatattgagcagttcatagagaatatatgcatattcgccgtctcttgagaaacggatcatacgcggggcagactcgagcggtccacggataatgtcaatcagttccagcttgccattctcataatccacgcggtagacttttacctgatccagtccgttgtcgaccgcacacagaaacttctgatccggtgtcagtttcacacagtccacgtgcggtacgaagttgcgctgtgcaatacttcttccgattcctttgtggaaaatgccgtccgcgattccaccgatgcttccgtccgcttccagatgcatcatgctcacgcggccgtcatgatgtccgcccacgaaaagatagcggttgccatcatccacttccacatagcagcctctcattccgccgatccactgcttgttgatcgaagtaagatcaccgtccttctcgatacggaaggattctacgccctcatccgcaatggaatacagaaatctgcgatccttggaaacaaccagatccgacggattgttgatcggaaccaccttgcgctccgtcagttttcccgcctcaacgtctacatcatagatatggattcctacgctgttctcgtgtgtataagttcctacatatgcaacatacttctcctgcttcatcgtcttccaccatcctattcttttcttcgcaaaatgtcatacatggcaagcggctgtccaaggtcgatataaagcacctgcttcggatgcggcgcggactccatatcattcccctcttcatccacgattcgctgcacagtcaccgtgatattggcaccgtccggcttcatgacctcaatgctctccccgacagaaaacttattgcgctgttcaatccggtagagtccctcttcgttccgctctccgacaatgcccagatacgtgtactccttcacataggtgttgttgtcgtaaatctgcgcttcgtccgaaggtttgccaaagaaaaatccagtcgtaaactgccggtaggtgcagtttgaaatctgctcctgataccacgccatatgctccctgtaaagctccggcgactgcttgtagtcatcaatggctcttcgatatgttctcgccaccgtggcaacatacagtgctgtcttcattctaccctcaattttaaaactgtcaatacccgactccatcaattccggaatatgttcgatcatgcaaagatccttggaattgaaaatataagtaccgcgctcattctcatagaccggcaggtattctcccgggcgtttttcctccacaaccgcgtatttccagcggcacggatgtgtgcacgctccctggttggcatctcgtccggtaaagtaattggacagtaagcaccttcccgagtaggagatgcacattgctccgtgaatgaacgtctcgatctcaagatcgtccggaatattggcacggatttccttgatctcagccagcgaaagctctctcgccgacaccacgcgctttgccccctgctcataccagaaccggtaggtgccgtaattggtgttgtttgcctgcgtactgatatggcgctcgatcttgggacagacttccttagcaatcatatagacccccggatcggaaatgatcagcgcatccggctttatctcccgaagctcggcaaaatactctctcacaccgtcgagatctccgttgtgcgccaggatattggcggtaatgtatactttcacatcatgggcatgcgcaaaagcaatcccctccttgatctcttccatggaaaagttcttcgccttcgcgcggagtccgaacgcttcgcctccgatatatactgcgtctgctccgtagatcacagcaatttttaatacttccagactgctcgccggtatcagtaactccggtcttctcatattctcgttcctctctattctcacacgcatgcatcgcatcttcatgcttcatgtaatcccgcacggattccgccatcttcccatcctgcgtaatccatgccgtccttaacgccttgtgctcaaggtgatgccatctcccaccgggagcaccgcggtcaccagttcttcactgtgcgtcagcgtgtacagatattcccgcatgcgcttatgaatcgtgcggttccgccttgtaaccgcgaaccgtgattcgatcacatcgccgtcctgcagcacattgtccgacaccagcacgccgtccttcgccagaaggcgcagaatctccggcaggaaatgaatgtactgcccttttgccgcgtccataaaaataaaatcatacggatcttccagcgtctttaacacttccgcggcatcgccctccagcagcgcaatctgcgcttccttcccggctctcttaaagttctccctggcaatcggaatccgcttttcataattctcgatcgttgtaatctgacacggcacaggatcgtactccgccataaggatggcggaaaatcccaccgcagtcccaacttctaaaatacgtgccggcttcttcatggcaagcagaaacttcaaaaagctctgcatctccttccgaataatcggcacgtaatcggctgtcgcttcccgctcaatctgatcgagcatcgcagtatttcccgcatccagagaattgatataggtcacaagtctctcatctactatcacggtgtctcctctgcatcccctgcatcttctgcggtctgtgtatcgtccgtctcatctgtcagatccgccgccccggtattcccggtgtctgcggtatcctcggtgtcctcggtactttccgtatcaccggcatccgctgccatgatcacgaacatctcccgcgcagtcatcgaggtatttaacgtgtaaacacccggtttgagttttccggagtaagcagatagtttcagctgggcatagaacagattcgcatcctccaccagcccctcttcttttaacatctttccgatatcatgctccgacatatccgccgtcacggatacggtcacatccctgcccggagtttcgtccaccgggctctcggtaaacacccggtatccgaagtcatagcagtaggagccaagttcaatcagtcccaccacaacaagcagtgcaaccaggatggaaaagctgatactgacaaatttgaaaacgactttgttccatttcataatcttctacacttccataattatcggcataatcatcgggcgtctcttcgtctctttccaaacaaaatcccccagagaatccttgatctccgtcttgatcttgccccagtctgtaatgcctttatccatacagtgctgcattgtatcatcaagcagatgcttggcatcgtccatcagtccctctgcgccgcggacatagacaaatccgcgcgatacgatatccggtccggcaagtacctgtccggaaccgccctccagtgtgagcacgacgataatgataccgtcctctgccagatgctggcggtcacgcagcacgatattgccgacgtcgccgacgccgagaccgtccaccatgatggctccggtgtgtacgcgtcctgtcactgccgctgcctcatcgtttaactcaagcacatctccggaggagagcaggaaaatattctctttcggaattcccagctcctccgcaactttcgcctgcgcaatcagatggcggtactcaccgtgtaccggaatcgcatacttcggcttcaccagggaataaatcagcttgatttcctcctggcaggcatgtccggaaacatggacatcctggaagatcacgttggcacccttcatcgacagctcgttgataatgcgcgatacagctttttcatttcccggaattgggttggaactaagaacgatcgtatcgttcggcttgatcgtcactttcttgtgcacgccgcttgccatgcgggacagtgctgccatcgcctcgccctggcttcccgtcgtgatgatgacggtctgctcatccgggtaacgcttcagctcctcaatgtcgattaacgtattgtccggaatactgatatatccaagttcggaagcaattccgatgatgttgaccatgcttcgtccctcgaccaccactttgcgaccgttcttatacgccgtattgatgatctgctgcacacggtcgacattggatgcaaaagtcgcaatgatgatccggtgattcttgttgtccgcgaaaatctcatcaaatgtcttgccgaccgtcttctccgacatggtaaatcccgggcgctcagcgtttgtactgtcgcacatcagcgccagcacaccttttcttccgatctcaccgaaacgctgcagatcgatagcatctccgaataccggtgtgtaatccaccttgaagtctccggtgtgcacaataatgcctgccggggagtagatggcaagcgccgccgcatcctgaatactgtggttcgtcttgatgaattccacacggaagcagccgagattgatatgctgtccgtattttacgaccttgcgctttaccttggtgagcatattgtgctctcttaacttgtgctcaatgataccgttcgtcagcttggtagaatagatcggcacattgatctctcttaacacataagggattgctccgatgtggtcctcatgaccgtgtgtgataaaaaatcccttgactttgtcaatgttgtccttcagataggtgatatccgggatgaccagatcgattccgtacatgtcatcctccggaaaagacagaccgcagtccacaacaataatactgtcctcatattcaaaggcagtaatgttcataccaatctgctccaatcctcctaacggaatgattttgagctttccactattctcttttttttcttttttcaaaatattacctccattattatttgtctcttaaaatgcaatgtccgcgtcgtcgagcagctctgcaaacacttttccgatggcagaaagctccgtgtcgtcttccacaagcacgtagacagattcctcgtctttcgtttccacctcttttaaaatatacgcatcacagtcgccgtcttcctcttccgtcgccagaaggtagtgcgtgccgccaacttttgtctcctcaaccacgaaaaacgcgagcgattctccggtgtccggatccacaaactttactttttccatatttactccattcaatgtttctgaaacgcgagtgaatccagatatccctgcagaataaacactgccgcgatctcatccacatactgtttgcgattctctctgcgtattccactctccatcatgtgccggtctgctgcaaccgtcgtaagtctctcgtcccacaggacgacagaaagcccggtgcggcgctccagcatctgtgcaaactctttcgtcttctcgcaacgctctccctcggtattgttcatattcttgggatagccgagcacaatgcgctccacctgatattctgttacaatctgttctattcttgccagcgtctgacgcagcttgttcggagactgtcttctcacgatctccagtccctgcgccgtcaacataagttcatcactgactgccacaccgacagtcttcgagccaaaatccaaacctaatatccgcatcttctattcccagttgttattcctgatgtaagccttcagcatctcctctaccagctcatcacgttctactttcatgatcaggcttcttgcattattatgactggtgatataagtaggatctcccgacataatatatccaacaatctgattcaccggattgtatcccttctccataagcgcacgataaacaatcgcgagcacgtcgctcacgcgaagttccggtcctttttccactttaaaatattgtgtgttattgatctcctgcatatttgtcacgcccttatatctgcccggactttaaagcggtgctgccagccaccgctctcttgtcgaaaaagcattgctgtttttattctaatatagtttgtcttaaaattcaactaaaagatagacgtcttctgttaattgtgtctttaaggtgcccgtcacaaacgtgttggaaaggtctttttttgtctctaccgccactttcacatactcttttgtgtacccggtgtagtaacgctttccatcatataaaaactcttcctccagaagcgccgtcacctgtctgccgagataataccggcggaactcctccgacatcctgtgaccgagtgcaagcagtttttcgctgcgctccttttttaccgcctccggcacctgatccggcattgccgccgccttcgttccctctcttctcgaatactggaaaatatgcatctcatagaaatgaatccgctccagataacgctccgtcgtctcaaattcctcgtccgtctcccccgggaatcctacaatgacatccgttgtgattgccggatgttcaaaatacctgcgcagcagcgcacagcccgcctcatattccgccgtatcgtaccgccggttcatgcggcttaacaccgtatcgcagccgctctgcaatgacaggtgaaaatgcgggcagatcttcggcagctccgagagtctttttgcaaacgcgtccgtcacgatacgcggttccaggcttcccaggcggatccgctcgatcccctccagctcatgtaccgcctcgatcagatgcagcagcgactccccgttgtccacaccgtaggaactcagatggattccggtgagcaccacctcacggtagccgctttttgccagcgtccgtatctcctgtaagacgtccggaagctccctgcttctgacacgccctctcgcaaacggaataatacagtatgtgcagaactgattgcagccatcctgcaccttgataaacgcccgggtgtgctctgccgtgcgcgaaagcgacaattcctcgtatgcctgcttctcgtgattgatgtccgccacacacgccatcttgcggtgggatgcttcgtattcccgaagcagcggcaccagctcatgctttttattattcccgatcacgatgtcaatcgactcatccacgagagcctgtgcctccttggtctgcacatagcatccggctcccacgacaatcgcatccggattctgctttttcgcccggtgcagcatctgtctggacttgcggtccgccatattggtcacggagcatgtattgatcacatagacatccgcatactccgaaaacggcacgatctcatatcccgcctcctccaaaatctgctgcatggcttccgtctcatatgcattcactttacaacccaaattatgcaatgctgctttcattcttgtttcctcatttctgtattgctttttgttcacgctttcttatggtttcatccgctttttgtgttgacttttccacgaaaaactattactataaaactatcttgaaacagataatcctaaggaggttttttatcatgaaaacagtacagatttcccttaactcgatcgacaaggtaaagtccttcgtcaatgcaattacgcagtatgaatatgattttgatctgatctctggcagatacgtcatcgatgcaaagtccatcatgggtatcttcagtttagatttatccaagcctatcgaccttgcaatccatgcagagaacaacatggacgagattatggagactttaaagccatacttaatctaattcatacatgacaggggtacacgccgcgggatttcccgcggctgtttttttatgtaacaggagacttcgttcctattacataaacccgcaccgcgaggatgcacatctacgcctcgatgtggattacctccaccgtatcgatggcttcctgcatcagcgcatcgatcttctcggaaagctttctctcatcattgtgaatcacgtttaagctcggctttgtcaccgggtgctttgccacgaaaatcgtacagcagtcctcgtaaggaaggatggatgtctcataagcgtcgatcttctccgagatctccacgatctcctgcttgtcaaatccgatcagcggacggtaaaccggcatcgtacatacctcattggttgccgcgagcgactgcatggtctggctcgccacctgtccgatactctcccccgtaatcagtccgagacacttgttctcttttgcaaaatgctccgccagcttcatcatgtagcgccgcatgataatcgtcagttcctcatgcggacactgttcgtaaatatataactggatatccgtaaaattgaccacatgcagattgatcggtccggtatatttggaaatgatctttgccagatccacgaccttctgcttggcgcgctccgacgtataaggcggcgcatgaaaataggtcgcatcgatggtaacaccgcgctttgcaatcatgtagcctgccaccgggctgtcgattccgccggataagagcagcatggcttttccgtttgttccgaccggcatacctcccggtcccggaatgaccgtcgagtacacattgatctggttgcggatctcgatattaaacatcacctgcggcttatggacatccacgctcgtctcggggaacgcctctaagatccgctcgcccatctgggcattgatctccatcgactccaacgggtaattctttctcgcgcggcgcgcattgaccttgaacgtaaaatgcttgtccgggtatacctcgtcgatatagcggatgacttcccccgccagcgcatcaaagccctcgtcctccagcagtacgaccggacagattcccacgatgccaaacacatgctgcagtgcctccacagctccatcgtaatcgtattcgccctccatctcgacgtagattctgccctgctccttgcggatatggaacgtgccgtccaccttctttaaggcatgattcatctggctcaccagcgcatcctcaaacagataacggttcttccccttgatggcaatctctgcatatttaatcaaaaatgctttatatgtcatggctctctcctttactttctggtgaactttctgcggaacggaatgatctctttcattttttcgaccgcataatccacttcttcttccgttgtgttgacgcagaagctgatccggatcgtggactctaacttctgcttcggcagaccgatgccctgcaaggtgcggctcggtgccggcttattggacgagcatgcgcttcccgccgacacatagatgccgtattcttccagagaatggagcatcacttcactgcgcacatcctcgatcgtgacactcacaatctgcggcgcagagtcccgtcccgttttaccgtttaccgtcactcccgggatctgtgtcacctcatcgatgaacctctgcctgatctcatacatatgaccggtcttcgcgtcaaaattctcatagatctccgccgctgcctcgccgagtgcagccacgcccggaacgttctccgtaccggagcgcattcccttctgctgaccgccgccgtagatgatcggttttacttttaccttatcgcgaatatataaaaatccggttcctttcggcgcgtggatcttgtgtccactcaccgagagcagatcaatccccatctttttcgggcagatgcggaatttgccgtacgcctgaatcgcatccacatgaaacagcgtgtccggattcttcgccttgatgaccttcgccgcttcctcgaccggttcaaccgcaccaatctcgttgttcaccatcatgatggacaccagcaccgtatcttcccgcactgcatcccgcagttcctccagcgaaataataccgtcatgatccacagacaattccgtgatctcatagccgagttcttttaagtaggcaagcggcgcctgtaccgacgcatgctcaatcgctgtcgtgatgatatgctttccctggcgcttgtttgccagcgctccgccgatcagcgccatattgttcgactccgtgccgcccgacgtaaagacgatctccttctcatcgcagcggagcgtcttcgcgatctgctcttttgcttctttaatataatcctccgccgtctttcccatgttgtgcagggaggacggattgccgtaatcttccgttaagatctgcaccatcttgtttttggcgcgctcactgcaccgggtggtggcagaattatccaaatatgcttccatctgttttaaaaccatgcctttctaacaaacgccgacgcagaatcacggctgatcccgctcttcttccgcttccgacacactctcgatatgatacatcagaatagaaagggttgcaagtcccgccgtctccgtgcgcaaaattctttttccgagggacaccagatgcatcccctcctcttttgccagcgcaatctccgacggatcgaatccgccctccggtccgataaaaatgccgacgctctgccccggtgcaatccgctccatcacttcccttgtggccgccatgccgcgctcattctcatacggcagcagcaccacgtcgagttctcccgccaatgcgactgcctcccggtaattcaccggttctctcaccaccggaattctgctgcgctttgactgttttgccgcactctttgcaatctcctgccagcgcgccgtctttgccgccgctttttttgcatccagttttacgacgcagttcttcatcgccaccgggatcatctccgcagcgccaagctccactgccttctggatgatgagctccatcttgtcgctctttggaagtccctgaaacaggcagatccggcagggcagttccgtatctaaagccgtctcctccgtgatgcacacctccaccacgttctctgcgatccggtcaatcgtgccgaagaaattcctgccggatgtgctgctgatgcgcactttttccccgcatttcatgcgcaggacattgcggatgtgatttacatcgcttccctcaattatcaccagatcatttgcaatctgctcgtcttccacaaaaaactgatacataaactcctcatttccgggctgcctgccattccttcggatcatcttccttttttcggatcgtctttccttattccagatcgtcttttctttttccggatcgtcttccttattccggctttctcgccgtaatgttcacccactcgccctgatgattgatctccaccaccgtaagtccggccgcttcgatcgcttcttttaccgcgttctccttgaaatcgatgatgcccgaggtgataaaataaccgccgcgtttcaagcgtgccggaatcaccggtgccatcggaataatgacgtctgccagaatgttggcaaccacaatgtcgtattcctccgtgccgactttctcctgcagtgctgcatcatcgatcagattgccgacataaaatgtgccaagcgaaggatcgagatggttcacttccatattctcatgtgtggaggtcatgcagtccggatcgagatccgttccgactaccgcggacgcgccaagcttcaacgccacaatcgataaaatgccgcttccgcagccgacgtcgagtaccttcggcgtgcggttttccggtgtgtacgcatcgttcccgcggatatactttaacagctggcggatgcacagctgcgtcgtttcatgcttgccggttccaaacgacacacccggatcaatctcgattaaaaatttgtcggcatcctccggctttaattcctcccaggtcggtttgatcaggatgtcatcaatatagaaggaactgaagaatttcttccagttgttgatccagtccagatcctccgtctggtcggaggtgatcacgccgcttccgacatccacgacttttcttaagtcctccaacgcctcttttacctgctttaacagttcggtgcggtcctcgccgtcatcctcaagataaaagctgacgtggctcacaccgtcatccggcggaagctccggcagaaaatcgatgaacatatccgcctgatcttccttggacagcggaatgttatcctcaatctccactccctcaatgccaaggtcggctaacatcgcactcatgtagtcctccgccgccgtcgttgtctctatcgtgtatttattccatttcatatgcgttcttccttcccttacgattccgttcctaaaaatcgttatttatcttatcatacaatcgcacatcttgcaaacgatgttccgccccgctctccgcctgcgggaggtattcctgatgcagtatacaaaacacattctttgcctgttgcacaaaaaacgggccgcggcacctcttttgcgccggacagcccgtccttatttcttcttacaatacctttgataaaaactcctgcagtctctgactctttggattgccaaaaatctcctgcggggttccctcctcctggatcacgccgtcgttgataaacatcacacggttcgcaacttctctggcaaatcccatctcatgtgtcacgaccaccatcgtcatgccatcctccgccagttcctgcatcacggcgagcacctcgccgaccatctccggatcaagcgccgaggtcggctcgtcaaacaggatgatgtccgggtccatcgccagcgaccgcacgatggcaatgcgctgcttctgtccgccggaaagctgcgcgggatacgcgcccgccttatccgccagaccgatgcgctttaacagctccatcgcgcgcgtattcgcttcctcttttgtcatcttgccgagttttaccggggcaagcatgatattttccagaatcgtcatgttcggaaacagattgaactgctgaaacaccatgccgatcttctcccggacatgattgatgtccaccgacggatccgtcagatcggttccctcaaacagcacatgtcccgccgtcggaatctccagcagatttaaggagcgcaaaaacgtggatttaccacagccggacggtccgatcagcgccagcacatcgccctttttgatcgtcgtcgagattccttttaacacttcatgaccgtcaaaagacttgtgaagctcttttacttccagaattaccgtattatcgctcattgcttctcaatctcctttccaacagtccgactgccttgctcagtcccatgacaatcaggaaataaatggccgcgaccgcaattaacggcatgaacgcctcgtacgtcacgcttcggatgatgtctccgcccttggtcagatccatcagcccgatgtaaccgctgatcgaagtctccttcaacagactgataaactcattgcagagtgccggcagaatatttttgactgcctgcggcaggatgatgcttaacatcgtctgcttataatttaatccaaggcttcttcccgcctcaaactgtccgatgtccaccgccataataccggaccggacgatttccgccacgtaggccgccgagttcagtccgaacgcaatgactgccacgaacagttttcccgtattgacgctctggaaaatgacataataaataatcagaagctgaatcatgaccggcgtaccgcgcacaacggcaaggtatgccttgcagagtgcatttaagatcgtaagcccgccgtttctgtcgtggttggttcttacaatcgcgatcaaaaatccaaacacaataccgatcattaccgcaaacacggtgatgatgagtgtatttaaaagtccctttaacaaataggtatatcggctgtccttgataaagttatcataaaacttctctgctatccctgtcttctctgctgtgacagatgtatctctcacgatgatgacctgcttggattttgcataggtatccgtgaaattcacattctttttgcgttcctccgtcaccgtaaaacccgatgcaccgatgtcgacttttccggtggacaccgcaggaatcacggaatcaaacgccatgtcctcgatctttaactccatgccgagtttgtcgcagaccgcctgcataatatccatgtcgattccggtgatctttccctcttcatagtattcatacggcggaaactccgcattcgtaccaacggtaagcgtgccgttcgtgcgttccacatccagaatttcatacggatactttccaatctcctcgtccgttccggtataattcttcgcaatgctatcgagaacaccctcgtccttcagttcgcgcagcgtctcattgacctgatccacaagtgcctcgttaccctttgcgattacgaacgcatagtcctcctcaacaaagttctcctcgagaatcttaagcccttcgttctgctccacaaatgccagcgccggcaattcgtcaataatcacgcagtctaactttccctgctttaatgcctgcacggcatccgcgcccttattgtaacgctctactaccgtgcccgagccgtccgtctcatagtcgctgaccatgatatctccggtcgtgccgagctgtacaccgatatgctttcccggaagatccgcaaccgacgtaacagaaccgtcgccggatgcctgtcccgcctccgtgtcgctgcctatcgccgtcgccgcggcaacctgtgtgccgtaacctaacagcgtcgaaaaaaagaccgctccggcaagcagtatgccggataatttgattgctgtgtttttcatcgtactatctacctcatgcttccttatctctcacatagatactgcataaatatacatccggcagtcagtataacacagaacgccccgcttgggaagagattcattcaatctcgcagatccggtagagataacttcttccctgctttccaatccgctccacaatcaatagatccgtcaggagcaggagcaccgtctgtgccagccgcaccggaatcttcgcgcatgccgcaaaatcctttgcagtaaactcctccggaatctcataggggatgaactgcatgtagtcctccctccggtccacacgcacttcctccacgaaggtaagcggtatccggtcgaagcggtcgcttcccttctttttgtcccggctccagccgtttaacagacggtattcctccatgtcaatgagatccagccgtagtctcagattcggatctttcagaaacggccggatcttatacaattcgatgaatgcctggtatgcatttcccttcttgggcgatttgcgcccgggagagatctcccccgtctcctcatccatccagtgaagccacttcacatgcggaatcggatagacgatggtcaccgggtacaacggcagaaatgcggcaagtttccgccgcatattctggaacgaccgcgtctgaatctcgatcactgcctccccgtcaaaaatatccgcaacaaaattctcaatcgggatctcatgcatatcctcatccggtgcataataattcttgagcactgcatgtaccgtcttctccgagagtgtgccgattccaagcctctgccgctcgattccaatgactctgcccctggcacgctcaaaacgttctgtatcaatgcacatatctcatcctcgctgctgtgctttttccggaatgatctgccgcttatttcgggtgcttcatatcctttaagatatcaaagcagtcaaacgtgcggaaatagtcctccggcgtctcggcacgacggatcagctgtgtcgatccgtcttccttcagcagcacctccgctgactttaattttccgttatagttgtatcccatggaaaaaccatgcgcaccggtatcatgaatcaccagaagatctcccatgtcgatcttcggcagcatccggtcaatcgcaaacttatcgcaattctcgcaaagtgagcctgtcacatcatacttgtggtcgcacggcgcatcctccttgcccatcaccgtaatatggtgatatgccccgtaaattgccgggcgcatcaggttcacggcacacgcgtccacaccgatgtactccttgtgggtatgcttctcatggatggccgttgtcaccaggcagccgtacggtcccagcataaaacgtcccatctccgtgtagattgcgacatcgccaagtcccgccggaactaagatctcctcatatgccacccggacgccctctccgatgacacggatgtcgttcggcgtctgatccggtgtgtacggaataccgacaccgccggagagattgataaaacggatatcgcatcccgtcttatcgcgcagttccacaaccagttcaaacagttctctcgcaagcttcgggtaatattcgtttgtcacggtattgctggcaagaaacgcatgtacgccaaaatgcttggctcccttctcctttaagatcttgaatccctcaatgatctgctcgtgggtaaaaccgtactttgcatcgcccggattatccatgatgccgttgctcatcttaaagacgcctcccggattgtaccggcagctgatcgtctccggaatcctgccgatcgttttttccagaaaatcaatgtgtgtaaaatcgtcgagattaatgatcgcaccaagctcattggcaaatgcaaattcctccgccggcgtatcattggaggaaaacatgatgtgttttccatcgaagccctgggaatccgcaagcatcagctctgtcagcgacgcacagtcacatccgcagtcatattcttttaaaatgtcaagaatgaacgggttcggcgttgcctttaccgcaaaatactcccggaatcccgggttccatgcaaatgcttccttcactgccttcgcattttcgcggattcctttttcatcgtagagatgaaaaggcgttgggtatttttttacgatttcctctaactgttctttggttacaaatggtttcttcttcatacggttcttcctttcttcctagaatacgacttgtatcaaaaacatataaagtgccgttccggcaccaatgctgagcagattgttgcgcttccatacatgaagcatgatgaccgccgccacggcaataaattccggcaggccgaaaggcgccgcaagcaccgacacgtttttcaggcagtagatcaccagcattccgatgaccgccgggggcagcactctccccagataccggatgatcggcggaatctcttttcctttcgggaaaaacagaaacggaatcagcctggtaaaaaatatcgttcccgccacggtaaatatgatcgcaagcgatcttccaacacttactggcactccggctcgcctccttcctttccgtcctccggaatcattttatcgaatatttttttgcaggaaagcaggatgaccatgacgcatatcatggtcggaaggataaaattgtccgctccgaacaccagcctgcacaccagtccacataccagcccgatcaccacgctcggacggttctgcttctccatccactgttccaccatgattaccacaaacaatgccgtcattgcaaagtcaatgccctccgtggagaacgggagcacatttccaagcagggcgccgatgccggagccgatgatccagtaactctggtcgagcacggcaatcgcaaacaagaactgctcctccttcacatctttcggcacttttgtgacgaagaaaagcgagtaggtctcatccgtcagggaaaagatcatgtaaagccgctttttccccatcttagaaaatcgttccagcagtgacagtccataaaaaatatggcggatattcaccataaattccatgaaaatcacattgaggaggctgacgcccggcgcgaaaaagttgactgcaagatactgtccgctgcccgcatagatcaccagactcatgagcatcgcccacaagaagttgtaacctttttcctgtatcatcactccgaacgccatcccgataaacagatagccggtgagcaccggtaccgtgtagggaaacgctgcccgaaatgcacgtaaatatgttcctttccgctcgacttgtttggttttcatttttttctttcctaatcccgcaaattatgctatactttttctagttatacattcagtgaagttgttttcaagggagttaccaatgagtattacgatcttaaattatcacgatcaggcatttgtggatcagatcaacgccgaagctgctgcccgcgctgaagcggagagagctgccgccgaagctgcaaaagcgcaggctgcaagttctgacttttcttccgttttaacgaatgccaccgacgcctactccggcagcacgacctgctccggagacctttccgccatctttgatgaagcggcgaacacctacggcgtctcctccactcttttaaaatcaatcgcaagagcagagtccaattttaatacaagcgctgtcagcagcgccggtgctgtcggtattatgcagctgatgcctgccaccgcagcatctctcggtgtcacagattcctacgatgcctaccagaatatcatgggcggtgcgaatctgatctcccagctgcttgccaagtacaacggcgatacctctcttgcgcttgcggcatacaacgccggcagtgcaaatgtcgataaatacggcggtattccaccgtttagcgagacacagaattatgtccagaaggttctctcctatatgggaagcgatacgaacaccgttgcatccgcatccactgcagagacttccgaagatgttgcaacgacggtaagcaattttatcgcggcaaacaacatcagccaggatacggtagagaagctgcttacgcttcttgaagtgttaaacgcttaacaattacatttcatacaacagtaacacatgagaatcctgcctgcaggattcttttttgtgtaacaggaaacttcgttcctattacataatatcatccttctgcctgcgtccctgtaatcgtctcgatctgctcttccagatagccgttgaactccgtcataaaacggctcaccgtcctcacatcctcgacggaatagcgcgccagaaattccatatcgcgcttctcccatcgctgatgccgcttcgcatgctcatcaaacaaaagcctgccctgatccgtgagcttgaaatatacttcctttttgttcgtctccagcgtatatttttcgatcagccctttggcaagaagcttcttggtcatcttgctgatcgcgccgcgcgtcatccccatgtgctccgccaccttcgtgacgttcggcagttccagtcttccgatatagtcgatacagtgtgtctccgaatagccgtattcatccagacactggttttccgtcagtttggaaagcatatcctgccgctccagcatgagcgcgatttcttttaacagctcttcccgatctttcatgcagactcttcctttttctaacatggtattttgttcccagttcctactgtatctcattattgtttccatgtcaacaatatatttcttttacctgccgctgatgatgccgtagcactccgggcgcctgtcgcggaacagcccccactccagccgtctggcatccagctcgtccaggtcatattcctgcaccagtatctcttcctcgtcgcgccctgcctccgccagaatttctccggtctcatcggtcaggaaagacgatccgtaaaaaacaagcgccgaacgctgtccgccgttttcctcacagggttctaccgtctcctccccgatccggtttgccgcaacaacgggcatcagattggctgccgcatgtccctgcatacagcgtctccagtgcggcatactgtcgcactctaagatcggttccgatccgatcgccgtcggataaaaaagcagctccgcccctgcaagcgccatacagcgcgcgctctccggaaaccactgatcccagcagattcccacgccgattctgccgtagcgcgtagaaaatacctgaaatccggtatcccccggcgtaaaatagaacttttcctgatagtaatgatcatccgggatatgcgtcttgcgataaacgccgagcactgttccgtccgcgtcgatacaggcgatggaattgtacaggttgttcacatcccgctcataaaagctgatcgggagcaccacaccaagctccgcggcaagccgcatgcccatgcgcaccgcatcgttctccatcacaggctttgcataatgatagaagtcataccggcgctgctggcaaaaatattcccgctcaaaaagttccggcagaaggatcacgtttgctccctctgccgccgcctttcgcaccatggcttccgccttttttaaattctcctccacagacgccgcacagcgcatctgaattgccgccactttcactctgttcatgctcttttcctctttttgtctctgtccactttaccgctgctacatttttgctgctgcgttttgctgctgcatttttgccgccgggatctgctgtgtaatacagtggatattcccgccgccgactaaaattgcacgcgcctgcaccgaaataatcttccgccccggattccactgcgcaagcagtgcggcagcgcgcctgtcactctcctcattctccccgccgaacgccggaagaataactgcctcattggaaaaataaaagttcacgtaggatgccgcaagacgctctcccgcctcccgctcatcctccccttcggcaaacgaataacctgccagttcctcctctgtaatgcagaccggatgatcgggaatcggaagcttgtgaatgacaagctttcttccgcgcgcatccgtctcgccctccaggtacgcaagcgtctgctgtgatagcggatactggggatctgtttcatcgtccgtccaggcaagcaccacctcgcccgggcgcaggaacgcgcagacgttatccacatgttcgttcgtctcatcctgatagattccacgcggcagccacagcactttttctatgccaagataagttctaagcttctcctcgatctccccgcgcgtaagccccggattgcgccccgcgctcaaaaggcacgcctccgtcaccagaagcgtcccctcaccgtcgctgtgaatcgatccgccctccagtacaaacggcgcggcatcgtaacacgcatagccatactttgcggcaaacgcctttgcaaacgcatcgtccaacgcccaggatgcatacagtccgtccaccgatcctccccaggcgttaaatgaccaattcactgcccgcatcctgccggcgccgtctttcacaaaggtcggcgccacatctcttgcccaggcatcgtctgtctccagttcaaagaccgtcacccgctttttccacggcgcgtcctcaccgatcagcatctctcgcgcggagtcaatggcatcccgcccggctgccacatatacgttttcactctgcgcaatcgctgcaatcacatcccggaatgcaatccgcgcatcgcgtgcgccgtaaatccaggaacccgggcgcgacggccagatcagaatacagccgtcatgcggttcgtactcccccggcataaaaaatccgtccgcctgcggcgttgtcattctctcttttggatcttctgcacacttttgcatctttttctccatttcctctaccctcatccaagtcatcttcccttgtcccggatgtctttcaaaaccggttatgacaaccgccctttgaaatcttcatagccgaactgctttaacatctcaacctccccgtcttcccggagcattgcgatcgacggaagcggaattccattaaaggtattattcttcaccatcgagtagattgccatgtcctcaaacaccagacggtcgccgatctgaatctcatgtgtgaaactgtagtccccgatgacgtcccccgccagacaggtgagcgaggacagccgataggtgtatttctgctcccccgccgcaaatccgtcccgaagcggtggacgatacggcatctcaagaacgtccggcatatgacacgccgcagacgcatccagaatcagaatatccatcccgttgtgtacaatatcgcacacttccgttaccagatatcccgcatttaaggcaaccgcctcgccgggctccagatacacggcaagtccgtaggtctccctgatatagccgataagcttctttaaacgctctatctggtaacccggtctggtaatatgatgtcctccgcccagattcagccaccggacctgttttaaataagaagcaaactgctcctcaaacgcataaaacgtgcattccagatcatccgcgtcctgctcgcagagcgtgtgaaaatggagtccctccacatcctccggcagttcatagcttccatcctcctgccgtctcatgccaagtccggcaagtcctttctcaaacgcctctcttgtcatgccgagtctggaaccgggcgcgcagggatcatagatcgcatgtccctcctgcgtggaatactccggattgatccgaagtccgatgctgacacggtgctccgtaccactggcggcattctgcgccgccaccttcttcctatgtctgacatactgcgcaaaggaattaaaaatcacatggtcgcagagcgtgaccagttcctccatatcgctgtccttgtacgccggagcaaacacatggttctcacgccccatctcctctgcgccgagacgcgcctcgtagagtccgctcgctgtggtaccgctgatgtattgtccgatcaacggatagagcgcatatgtggaaaacgctttctgcgccagcaggacatggcatcccgtatcctgctccagattatgcaatattattaagttctcttttaattttttctgattcaccacatagcatggtgtcggaagttcattccacttcattgctctcgtctctccctgtccggctctttttacgaacggctacgccaccgtcttggggttctcatcgacaacccacggcagtccgtactgattgagcatatccataaacggatccggatcaaactcctcgatattgaagacgccgtccttatcccacaccttatctacaacaagtgctgcaccgatcattgccggaactcctgtcgtgtaggagatcgcctgtgagccaacctccctgtagcactcctggtgatcgcagacgttgtagatatagatcgtcttttccttgccatccttcttgccggtaaaaatacaaccgatgttcgtcttgccaacggttctaggacccagtgacgccggatccggaagcaatgcctttaagaactggatcggcacgatctctcttccctcatactggatcggggaagtggagagcattccgacatcctccagacactgcatatgagtcagatagctctgaccgaaggtcatgaagaaacggatgcgcttgactcccggcacattctttgccagagactcgatctcctcatgatgaagcagatacatgtctttctcgccaacctgtgggaaattatattctcttttaatttccatcggttttgtctctacccagtgtccgtcctcccagtaggagccgtttgcggatacctcgcggaggttgatctccgggttgaaattggtggcgaacggataaccgtggtctccaccgttgcagtctaagatatcgatgtactcgatctcatcgaaataatgcttcagcgcataggcggtaaacacgctcgtcacgcccgggtcaaagccgctgccaagaagcgccgtgatgccggcatctgtaaagcgtttctgatatgcccactgccaggaataatcgaagtacgcggtaaagcccgcctccttgcagcgcttctcataaattgcacgccacgccgggtcgtcggtatcttccggttcgtagttcgcggtatcgatgtagtccaccttgcatgccaggcaggcatccataatcgtcagatcctggtaaggcagcgccacatttaacacggcatccggcttgtagtcacggatcagtgcgatcagttcgtccacattatccgcatccaccttcgctgtcgtgatcactgtatccgtcgttccctgcagcttttcttttaacgcgtcacatttttcttttgtgcggcttgcaatgcagatctccgaaaaagtcttgctgttctggcagcatttgtgaattgccacccctgctactccgccacatccgataatcaataatcttcccatctacttatcctctcattctgccgtcctgcggctgtattttctattatatcattctgccaacggatgacagaacgctccgctgactgtcccgtcagagtccgttctgtcccgcatctgccatctaccttctgccttcctcttcctcaagcatatcctcgacatattttggcagcataaacgctcccttatgaagattggtcgtataataccaggtcttgatcccgcgcgctttccagcgctccacattcagatccgttagcgggtgatatttttttgacgcaaatccgaacagccagtacccggaggaacaggtcggaatgtgcgcctgatacacacggctgatcgggaaactgtgactcgccttgcggtgcatcacgcggcaggactcctcatcctcgtcataaaaaggactgccgtgctggtagaccataatgccgtcttcttttaatgcgcggtaacagttcccataaaattccttggtgaacaatcccgccgtatgcccgagcggatcgatcgcatcattgatgatcagatcgtaggcatcatgctttgtgcgcagaaagcgcagtccatcctcgtaatagatattgacgcgcggatcttccagtccgcaggcgttgtccgggaaaaacttcctgcacacatccacgaatgtccggtcggattccacgacgtcgatctgctcgatctcctcataataggaaagttctctcgccacaccgccgtctccgccaccgatgaccagcacttttttcacatgcggatgcaccgccatcggcacatgcacaatcatctcatcgtagatgaactcatccttttctgagaagacgatactgccatcggagcttaaaaatctgccgaattccctggattcaaacacgtcgatcctctgaaaatccgtctgctccccgaacagctgcttctccactttgaccgacaccttcacatgatcggtctgattatccgaaaaccataactccacgctctcttccaccttccccagaccgtatcgcacggtctgctgcttccttacgcctgttcttcctgactgtatgctcttccttaagagctattcttccggcggtcttatttccacacctgccggtcatccactaagacatttaagtgctccaccgccggatcttccgttccctgcatggagcagcccttctccttggcatagatgatatattcgatgatctccggcgtaatcatctcacccggcgcgagaatcggaattcccggcggatagcacatcacaaactctccgcagatctttcctgccgtctcccggatcggcatgcattttttctctgcgtaaaaagccgcctgcggtgaaacaagaacagtcggatttatatattctgtatttaacatctgtgcagggtccttggaatacaagcgtttgacgtctgccaacgctcccaccagccgctcgatatcctggatgcggtcgccgattgaaatgtaggctaagatgttggcaatgtcccccagctcaatctggatatcgtactcatcccgcaacagatcatagacctcgattcctgccagaccgattccccgcgtatagactgagagcttcgtcacatcaaagtcatagacgcttccgccgttcaccatatccttgccgtaagcataatatccgccgatgtcgttgatctccgccctggcatattccgccatctccgccactttgcggaacgattcccttccgcgcagcgccagatttctccgcgagatgtcgagacttgacatcagaagataagacgcgcttgtcgtctgtgtgaggttgataatctggctgacatactcccagttgacatttttgccggttaaaagcagggaactctgtgttaagcttcctccggatttgtgcatggagacggacgccatatctgcaccggcatccatcgcgcagaccggaaggtcctccccgaaatacagatgggtgccgtgcgcttcatccacaagcacaagcatctcgtgttcatgtgccagcttcacgatggagcgcagatcggaacagattccgtaataagtcggattgttcacaagaaccgccaccgcgcccggattctccagaatcgcccgctccacctccgagatctccataccgagtgaaatgccaagctttttgtccacctccggattcacatagaccggaatagcgccgcagagtaccagtgcattgatcacactcttatgtacattgcgcggcaggatgatcttatccccggcacgacagaccgacaacaccatgctctgcacggaggacgttgttcctcccaccataaaaaacgcgtgatctgcccggaaagcctccgccgccagttcctccgcctctttgatgaccgacaccggatggcacaggttgtcaagcggcttcatggaattcacatccagactcacacatttctcccccagaagttccacgagctccgggttgccacgccctctcttgtgccccggcacatcgaaaggaacgactcttctcttttttaattgttccagcgcttcgtagaccggagcgcgcttctgggatcctgcttccatgattctcctcacattctgttttgatgctccctgatgcggtatgcatgccgtccggcagagcttttggctctacaggaagcatgactttcatgctttcgcataacatggcatcttctgtagcacaagaaagaatcctgcccggagcgtttttatgtaatagggacgaagtttcctattacacaaaaaaaagacagatgcctatatgctgcgcacacatcacctgccttgtcacattctcatagtcatactttatgtaatctgtcctacatgctgcaaaaactattatcagagtctacgttggcatcttcgccagcaaatatttgctattactactcttattgaccgtttcacaagtgatatctctatcgcatacgattcagggtcctgcagtccttcgcctgcagtcgtcatcaacttataaaatttgagcttctaactcaatcaataacgtggatctctccaccatcggcagctgccccgcctgtccgtatgggcttaaccaatctcttggtgggcaaatatttgcatgaaaaagctttcgcattcatgtgatttgaagtataacacacacacttctaaaaagcaatgtatttctccggattcttatctactccctccactcccggaaaagtgcaatctctctgcggtatccctcatcgtcattcggagtctccagaataaacggcttgtccgaaagcagcggatgcgtcgccacacgccgcatcgcatccagcccgatctttccctcgccgatgcaggcatggcggtctttgtgcgaaccgcggtcgttcatgctgtcgttaaaatgtaccgcgcacaggcggttcagaccgatcacatggtcaaattcctccaggacaccatccagatctcccgcaatatcatatccagcatcccagacatgacaggtatccagacagatgccaagcttatcggacagctctacacggtcaataatcgcgcgcagttcctcaaagcttctgcccacctcactgccttttcccgccatcgtctcgagcagaaccgtcgtcgtctgctccggcgtgagcacctcgttaagtgcctccgcaatccattcgattccggcatccgccccctgtccgacatgggaacccgggtgaaaattgtagtaattccccggcgtgtactccatccggcgcagatcgtccgcgatcatctccttagaaaacttgcggatatcctccttcgccgcgcacagattcatcgtgtaaggtgcatgcgccaccagttttccaaattgctgctcccgcatcagttccagcagcttttccacatccgccggatcaatcgcttttgccgcaccgcctctcggatttcttgtaaaaaatgcaaatgtatttgctcccagcttcactgccatccgccccatcgccgcatagccctttgacgccgagagatgatttccgatatacatattcttttcctgcttccttctatctttctaagtcagcaaccaccagttcaactggtggtttgctataagccctccaaagggctatgttactgctcgccccaaagggcggtgtcacaagcatttttactggtccgctataaagcggtacttcttgaatcttcttttcttgattcttctgcttgttcttttatatacttctgtactgcctcgtctgtgatattaccgattgtttccacataatatcctcttgcccaaaatgctttatcccacttactctgcaactctgggtgacgatcgtatagcattagggtgcttttaccctttaaatatcccataaaatctgagacacttaatttcggtggtattgcgacacttaaatgcacgtgatctgcacaaactgctcctgcaattatttctacatttttatatttgcatagtgtatttaagatttcacgtacatcctcccttaccttcccatacaatacctttttccgatattttggaatgaaaacgatgtgatattggcatttccatctagtgtgtgatatgcttttattgtccacttggaccacctcctgtgttgagtttggcttgcgacaccattctcaatataccacaggaggtttttcttttttatcctcaccgtttccaactattccattctccccagcatagctgggggattaggcttttcatttaaatcttctccaccaggatgccgtcccggtatgcctgcagcagcgcctccagatcacggatcgaagcgcgcagctcccttccaatgtccgtatccgccaccagcttgcgtcgcacgacatgctgcaccagaatcgtatgcgacgcgatatcgcttccgtcctgcaccgccttttcgaccgactcaaacggttcatgcgccgcaagcaccagaccgtaggaattatagatcagcgtatatcccgcaatccccgtcttcggctggtaggccttggagaatccgccgtcaataatgagcagcttcccgccgcattttaccggggactctccccgcttcgcctccaccggaatatggccgttgatgatatgtgcctccgcgccctcaagcccgaattccgagaggatgcggttgaccacctcttcctcctccagcaggcggtagtacgggttcttcggctcctggtgcgtcgctgtgtccgcgataaaatagcgctcaaacgtcgtcatttttgcttttccgaacaccggggaattctggttttcccagataaaccacaagatatccagcccctttttcttctccccgggatcaatcgcgtagtacccttttctcgcgtaattctccagcacatcgtagagcgccttgccggaatattcttttccgtacacatttactctggtaaaggttccgtcctcgttcatcggcacacagccgtggtagagcaggttcccgttgtagaccttgtacaggctgccctgtgtgaacagaaaacggacgtgacgctgtaatttttcacagttcaagaacgcctgcgtgatccgctccatgacgtcctcctcctccgatgacagttcatacggatgcttccagtcgatcgtcgggaagttcagatccttcatcgggtattccttcccctccacacacaccgttcctttttcgatattgatcttgtccagcaaaagccgctcatccatcccgaactccgggtgacgcatgatcatctgtccctccagcttgaactggatcaccgtaatcgccttgtgcattttctcatccagcatggcgtcacgcacatcgtactcatcctcccggtaatccagcttaaagcaggtgcagggatccttgtcgtatctgctcatggcaagtctggcgagcggcaccagattgatgccgtatccgtcctctaaaaggttcagattgccgtacttggcagagatacggatcgcgttgcagatgcagggtctgcttcccgccgccgctcccatccagtatatatcgtggttcccccactgaatatccacggaatgatgctgcatcaaggtatccataatcagattcgggtacggtcccctgtcgaaaatatctcccaccacatgcagatgatccaccacaagcctgcggatcagattgcagaacgcaatcacaagctccggcgccctgcctgtgcggatcacagaccggatgatctcattataataagcttcctgatcggagacatccggtctgccggtcagcagttcctcgatcacatacgcaaaatctttcggcagcgcttttcgcaccttggatctggtatattttgacgaagcgctcttgcagatgcggatcagccggtatagggagaccttataccagtcctccatattttcttctgtctttaacacctgctctagcttctgctccggataatagatcagggtcgcaatcactttcttctctcccgcactgatcgcattcccgaattcttcctcgatcttgcgcttaatcgctccggaaccgttccggatcacgtgctggaactgatcgtactcgccgtgaatatctgtaatgaaatgttctgttccctttggcaggcttaaaatcgcctgcaggttaatgatctccgtcgctgccgcagccacggtcggatactgatttgccagactttttaaataccgcagatctgtttccatatatttttccatatgttccccctcagaatatcaaaatcgaagatacctctcaaatagtaacatatccgcgcactgctgaccagattttgttcgttttctgccctgtataaaaatgggaacagaaaacgtttccacgctcctgttcccattcgatccatctgtatctgctttcaatctgccttatccgtctgcctgtccaatcagtctgcctgttccatcgttgcccggatcgcatcctgcatatcataaaatcctgcctctttcccggcgaggaactttgccgcctccacagccccttttccaaagacgctgcgggaatatgcggtatgcttgaactcaatgacctcgtcgagtcccgcgaagatgacctcatgctccccgacgatgctgcctccgcgcactgccgagattccgatctcgtgcggatctctctttttgcgctcgctgcttctgtcatatttgtattcatagacatgtcccagcgcatcattcatggagtccgccagcgccagcgctgtgccgctcggtgcatccagcttctggttgtgatgcttctccacgatctccatgtcaaatcctgccggcgcaagaatcgttgccgcctgcgctaaaagctgcatcagcagattgattcccagcgacatattcgcggactttaatactgctacctgccccgatgccgcctttacctgctccatctgttcctccgacaatcccgtcgtgcacagaaccactggaatctttttatccacactatagaccagaagatcgtccacggccttcgcattggaaaaatcgatgatgacatccgccttcacatcgcagacggaaatattcgggaataccggatagtcatttttgatcccgtcatagagatccactcccgccacgatctcaatctgcggatcctccttgcagattgcggagatgacctgtcccattttaccattgcatccattcatgattgccttaatcatcgtacgttatcctctcttctctgtactgcccgctccgcgtgccgcatgcagccagcggtgcagacacatactccggcggatggccttacggctcccttccgccggagtcatctgttcttttatgctaactttattccgtaatttttcatcgcttctgcaagcttcgcggcattctccggtgtcatctccgtgagcggggaacgaagcggtcccacttccagtcccatcagattcaatgctttcttcaccggaatcgggtttacctcggaaaacagcgcatccacaagcggctgtgcctttaactgcagttctctcgcgcgcaaaagatcccccgcggagaaagccgcgcacatatcgtgcacatccgccggcgccacattcgaccacacggaaatcacaccgatcgcaccgattgccatcagaggcaccacgatgccgtcctcgccggaatataaatcaatcttgccgtccgttaagtacatcagcctggatgcctgagccagactgccggtcgcctccttgatacccacaatgttctccacgttcttaaagagtgtggctgcggtctccggcagaatattgcagccggtacgtccaggaacgttgtacatgataatcggaagctttaccgcctcggcaatctctgtatagtaacggatcaatccgccctgtgtcgctttgttgtagtacggggtcacagccaaaagtccgtctgctcctgccttttccgcctcttcggaaaggtgaatcgcctctctggtgcagttggaaccggtgccggcaatgaccggaacacgatgctttgcaaaacgcactgctgcccggatcacatcggaatgctcctccgtagtgagcgtcgaactctctccggtcgttcccacaatcacaatcgcatccgttccctgctcaatctgccattcgaccagttcctccagcttgtcgtaatttacctcttcattttccttcatgggtgtaacaatcgctacaccagcgcccttgaatatcgccatgtcaatcctccgtttctcctatgttaatatatgcccatggtacaattttgcccctgtcagatcagagtcagaataaaaaagtaaaaaaaagccggctcgatgagccggtctgattcttctgccgcatatctgcatgccattatacagaaccgatagcgccccatctgcaaagatgacagtcataaagttcttagctttatgcccaagaaccagggcagcaggtgccttgctctttcggcatgctttccttttgcttcccttcccctgtgcctgtcacatccggaaaactactcttaaagcacgcaacctctatcaaaatatgtatcatatagttaaaattaacatagcactatcaacaacggttgtcaataacggaactttcgattattcctctaaaaaatccaccttgctgacggacacctcgtaagccacccgtttttccgtctcaagctccgagatctttttgacgtattcccggctctggattctgccccatacctgcacatgtcctcccacctcaaagccggaggcaaaccgggcgtttctaccccagcagatgcatggaatatagtctgattttccgtaggaacggttgacggcgatcagaagatccgcaatctcccgtcccagcggcgtcttccggtaaatcggttccttgcagatatatccgtccagaaaaatctggttgctcttcatatcctcctgcagctcctccaaaaactccagttcccgcacgaacaccgataagacaaggcggttctttttctcctcatgccggttaaacgaacggaactgcccgttcacataaatgatctgtcctatgtaatctgcatttacgtcaatcaaccgttcggatatcattagcggaatgtaatccagataattgctcaggcggttcactgccacatccaccatataaaatccctctccgtacacttcgtgactgaaccggaaatcggatacaatctctcccataattgacacctggttgttttcaaaaattttatctgccatgaatctttctcccttcttacgaccatactcttttttgcgttgttcttctttttcgttccgttctgctggtatgatctgcctgacacattatttttatcacgtccggtgccagaattttcatgcaacatgtcgataacaaagggaatgaaatggcggattttgtcgcaagtaccacttgcgcatctccgaaaatatgataaaatagattggttacttttttagactaggtttcacacaggaaagagagattttgtatatgaaaatgaaacgtgaagatgtccgtaacattgcaattatcgcccatgtcgatcacggcaagaccactctggtcgatgaattgttaaaacagagcggcgtgttccgtgagaaccaggaggttcaggagcgtgtcatggactctaatgatattgagagagagcgtggtatcacgattctttccaaaaatacagcgattacttataaaggaactaagatcaacgtcatcgacacccctggccacgctgatttcggcggcgaggttgagcgtgtccttaagatggtaaacggcgttgtgctggtcgttgacgctttcgagggcgttatgccgcagaccaagttcgttctgatgaaagcgctcgagctttctcttccggttatcgtgtgtctcaacaaagtcgaccgtccggaggcacgtccgaacgaggttgtggacgaagtgcttgagcttttcatggatctggacgcttccgaggagcagcttgactgcccgttcctttttgcttctgcaagagacggctacgcagtccgcgagcttgacgatctggtgaacaacaaaaaggatatgactccgctgttcgacacgatccttgactatatccctgcaccggagggcgatccggacgccaacacccaggtattgatcagcaccatcgattacaacgaatatgtcggacgtatcggtatcggaaaggtcgacaacggctgcttaaaagtcaatcaggaggcggttgttgtcaaccaccacgagcctgacaagcagaaacgcgtccgcatcagcaagctttacgagtttgacggtctgaacaaggtggatgtcacagaggcaaagatcggttccatcgtagctatttccggtattgcagatatccatatcggtgataccatctgcgcacctgagaatccggttgccattccgttccagaaaatttccgagccgacactgtccatgaatttcatcgtaaatgacagcccgctcgccggacaggagggtaaattcgttacctcccgtcatttaagagaccgtctgttccgcgaattaaacaccgatgtttctctgcgtgtcgaggaaacggacagcccggattcctacaaagtatccggccgcggtgagcttcatctgtccgtactgattgagaacatgcgccgcgagggttatgagtttgccgtcagcaaagctgaagttctctaccacacggatgagaacggcaagaagttagagccgatggagcttgcttatgtcgatgtaccggatgaatttaccggtgccgtcatcgaaaagttaagccagcgcaagggcgaaatgctgaacatgaaaccgattaccggcggttacacacgtctggagttcaacatcccgtcccgcggcctgatcggttaccgtggtgaatttatgacggataccaagggtaacggtatcatcaacaccattttcaacggctatgcaccgtacaagggcgagatcgcttaccgcaagctcggttccctgatcgcatttgagaccggtgagtccgtaacctacggtctgttttccgcacaggatcgcggtacgctctttattggacctggcgaaaaggtatacgccggcatggtcattggttcatcttccagagccgaggatatcgaattgaatgtctgcaagaaaaagcacctgaccaacacgcgttcctcttctgcggacgaggcactgactctggttccgcctaagattttaagtctggagcaggcactcgatttcatcgatgtcgacgagctcctggaggttacaccggagagtcttcgtatccgcaagcgtattcttgatccaaccttaagaaaacgcgccggcatgaaaaaataagtcgtatttctactcttaaaaaggagccatgtgcaccgtttcctatggtgcacatggctccttataaaatgcatatccattttttccgtttttcttcactgtatacatcgcagcatccgccgctgccagaagttccgttgcatccgctccgtgttccggccacaccgcgattccgagactgactcccagtgtctcgtccgcctctcccattctgcacggcttttgcagacgttccatcaaaccagatgcatatcgctctatgaccctgtaatcgccgcagtcgatcagtgctacaaactcatctcctgccaggcggtacggtgtgaaatggccatcctccaccgccagcgaccgaagtgccacttcgcgcagcacctcgtcccctgtattgtgtccgtaggtgtcgttcacccgcttaaaattatccagatcatacataaaaaccgtaaattcttccccggaggcaatccgctgcctgatatcttccataaagacactacggttcttaaggtgtgtcagtacatcataatgtgcactgtaagacagtttttcgtttgccctggtaatcacttcgttcattttgcgtcggcgcatattgtccaccgccagccatgccaccattgccaacgccacggcagcaatcaccagcgttgccctgatcgtatcccggttcttttcccagaaggtctccctgtgattgatgatgactgcatccccgggaagctttgatgcactgattccaaacctgcgcatcacattttcatcaaagcaatataccttcggcggctccatcacaatggagatccctgcacaatccgtgccctccagtatctgcaccgccatttctcctgccctttttcccatctgttcctgcgagacaatctcgccgcctaaaaatccttttcccataccgtgcgagacaattgaaaacatcggaatctgcgccacatcactcagcatctggatcgcttccgccgccgcgtacacattcccgtcgccatccctgctgcacataatatagaccagaatgctctcctcccccagcgcagcaacctgtctttttaattcttcctgggagagctttgaagcgtcgatctctacaaagtccaactctggaaaaacagtatcgtaatactggaattccttgcgttcgccctctccggtcaccgtatcatccagtattcctaccacctgtcttgcatccggatacagcttctttgccagcgtgatcgtattctcataagagagcgtctcaaccacgcccgtcacaagcggatctgctgccgctttcttcgccagttccctattattaactccctcaaaaacaaccggcgtctgcgcaaacaactcatcccgatacgtcattgcaaactgaaacgccgcatcatctcctacaatcacaacatcatacgccggaaccatcttcagatagtatgttagcgtctggtaaaatagctgttcactctccgccgtctcgacatttttggtatccataaactgataatccagctgtacaccagcgcccaatgcttcttttataccgcgaatctgttccggaaccgtctcccatgcataggaataggaactgataaataataccctgccggtgatttccccagcgtccggcaccagttcttctgcatatgccggaatgcctcccacacagataagaagtgcaatagcaaaaaaaatccggtaccctttttgaatccatcgacgttctatcacagacactcctcctccctatccgtatatcaaaattttccaccctcccgcttctattgtcaatattttttcactgtttttttacggttttctgatattttacaaccgccggatccgtcatctgcagcgtcctcttccactccctgctttcccccactttctgcaccgcggaacggttcttatataaaaagcgcgtcagattatagcagtccacccagatctcgttgtttccctctttctgcgcctcgtcaaagatcagctgcagcccgaaatgcagatgaaccgtgtctatgttgttgacattttccttcgtgctgtacccggtatgccccatatagccgatcacgtcccctgccgtcacgacatccccctccttcaactgttcccggtacggatagttctggcgcagatgcgcataataatagtaacgcttcccgtcaaagctgcggatgccgatgcgccatccgccgtactggttccagccgatcgcttctacgtagccggattctacggcgatgattggggttccgacctgccccatcatatcatgccccagatgctgcctctgatacccatagcttcttgacactccgaaatcatcataatcactgtactcaaatcctttggcgatcggtgaaaatgctttcagaccatacttttttacatatgctcccccctccttttcctgtatctcatattcaccgaccataccgccaaaaaccgctccgtatgcctccctgtagtaggaaaacatcttcatatccgcggtcatatgctccattgtatcctccccgcagagaattttttcagcagcggtacgcatgtcctccgttgctccggctccaaaatctccgccgttctttgccccggcgtacgccagaagatctatccagtcaagatgctgcttttctccgtaactacttacgtcataatcatatgccctggacaatgcctcataggacacgttaaaatctacccatttgatatagccgtccgccgttgtctccacgactgatttttccggcagttttccattctcccagaggattactcccatcagaaaaagcagtgccgcctcaaggatcactgccgagcgtatccgcctgcttttctccattcctttctgctccgttttccattcctcactgtcatggtcattttgttcattatataaaaaaagactgcagactattcctgtctgcaatctttacagataccgtataatatggaatttttgcactgcagctgaaatccgtgatccttttgaatgtgctctgcaatctcatccataaatccgcagtcgagatgaatgatacatccgcatttgacacatttcagatgaagatgctcatcgcagtgctgtcccagttccacgtactgatacactgccttgcctcccgcctccgccacatatttcatgacggtaccatctgtggcaagcttatccagataacggtaaatcgtcgtgatattgacggcatcgccatttcgcttcagatattgatcgatatccgccgctgtcacggtccggtcactgttgctttttaaaaaatcaagaatctttctgcggctgtttgtcgcatatccacttcctgccatctcatccctccgcaactgcatctattttcattatatcatcttttctgcgccgacttctgcgcatccgaagttccgcaggaacttctaatatgaactcgtcagagttcattatatcaactacgcttcggcaaaagtccggaaaaactccgttttcccggactcgcgggcatgttcacatggaacatatccgcccgacgcatgcaagcatgcgcgtccgtctttgctccatgctcacttttgccttcgcgaacattatatcacatttttacgcttcggcaaaagtctgtgaaaccatatccctgtctcctaaaatacaattccacatgcttcaatcatgacaccccagagcacaccgagcacatacatggtagcgatgatggccgcattctgcttatagtcgcggttcagccggaacagtaccagaaatcccacaccggcattcaccaaaagtcctgccatcatggcgcccgaccggataattccatccagatacaactgtgtgattacaacggacgacgcacagttcgggatcagccccacgagggcagcaatcagctctcccacaaccggaagtccggaaaacagtcccgccagcgtttcctctccgatcagcccgatcacaccgtttaataccagtgaaatcaggaaaataaaacaaaagatctttaccgtatgcttaaacgcggaaaccacaatcccatcctcgcaatgacaatgctcctcctcacacacgacatgaatatccatctctttttcctgcttcttcaaaagtctcacatataccagttccacgatcagaccggacaacacggcaatgatcaccttactgccaagaattttcacaatcgtcgccaccggcaccgactccgaaatcagaatcgggagcatctcatccgaagtggacaaatagatggcgaccagcgttccgactgtaatgactcttccggcaaaaagactcgatgccgctgccgaaaacccgcactgcggaatcacaccgagcagaccgccccacacaggtccccattttccagcggactgtatcttccggctcagcctgcttcccgtatgatgttccaatgcctccataaaaagataggtcaaaaataaaaacggcaaaagcctgacgctgtcaagcactgtatccaataatacatccagcataaaatcattcctccctggcgatgcagcatcgccgcctgatatactgtcttccctgcatgatgcacacttttgcaaatcattcgtttttgcaacctgcatgcatttgcaactcatttgcattttgtattatacattgatatcgtgttttgtcaagctttttatcgtatttctttcgagtgccatatttggcaccacactgctgcccggctataattccatccattctttgtgctgcattctacacaaaacaggaagcagactccgttcaggctcatatttgaaatccatccagataccctctgtccagatacagttctcttaatttttcgcggtacacttcctttgtattgtacggtctgccaaaatgaattccgtccgaaaactggtccgccggataataggtaatttcagaaaaataatccgggaaaagccgctccaatccccgtgtttcaaaatcctgccggatctgctccacctgcttgcggcgcgccggtgtatctgccagcggatcggggatcagatagcatgccaccccctgcgtgtcgcacaattcgtaaattttccgcagatagcgctctgccagatcagacatgccgtctgtccggtcatctccgcttttccccttcttcgccgcttcctcccgctccttcacataattcaaatacagcttgcggtttaccgccgaaccggcgatcagttctgccaccggctttttcaggaaaaagcttccgaacgtctcctccatttcctctgcggtctcctcgtcaagttcgcccagcagatccgcctgcaaaaacggaagaaccacataagaatagctgtatgtggcatcaatcgacgtctgaagcagatccggtcccgccatcagccagacttccgagacattctcatgcgtctccagaaattcttttaccagaagatattcccccgccatggtcagcgcgcgattatttccgaccagacagtattgttgattacaatcataaaacgcttccgtcatctgtgcgcagacactgtcaccgaccaacagcttcgtgtaactgcccggcgttctgctctttgcaagatacgcagccacttcccgctcggctccctcctcgtaatcactgctgtccgtcaacgcggcaaacacaccgcgaaatctctccgtcgccgacaacagatcaaaggtcagaagcagtaccgcaaatattcctaaaaaggcgatcaacttttttgtaaaacgcttcatgccttcctcctaaaattgaaaataaagaaactccgccgccgctcttccgtaattctgcagcaacagcacgacaaatcccagaagaaccagcatgtaaatactccagcgaatcacaagcacctgctttgcaagccaggcacgtatggaaatcccggattcatgcaggatatccactacaagcagaactccgatggtaaatgccagctgatacacctccagtctgcaaagccccatgccaaataatgtgccatcggtaaactgtcccagccagttaccgttttgcacaatccgccgaagcatcgccacagctcgtcccagatgatctgccctgaaaaaaagccacgcaaaatccgtgaggataaatgtcacacaaatccgggcagcgcgcgtcagtccctgcattttttccgaaaaaaaacgtatctttttctccggcagcctcttttgcgcggcctcacttacatatctgatgcctctgccagccacctgatagcttccatggattgctccccacaccacatagtgccagcctgcgccatgccagagcccgctgacaagaaatgttatcatcaggtttacagcggttctcccactgctgccgcggcttcctcccagcgggaaatacagatagtcgcggaaccagctcgagagactgatatgccatcgtctccagaattcccggcaattcactgcaaaatagggctgtcggaaattatccatcaggcggatgccaagcacctgcgccgccccgatggcaatatggctgtaaccgccgaaatcacagtagatctgtaccgcaaacagcaccgtggcaaacacaagcatgccggaggaataattccggtaatcctgatagacctgatcgaccagaatcgcagcacgatccgcaatccacattttttcaaaatacccccacagcatcagaagcagtccgtcctttaccctgtcatagtcaaactctgccggctcccgcagctgtgcaagcagactgctgctccgctcgatcggccccgcaacaagctgcgggaaaaatgacacaaacagcgcaaaacgcaggaaacttttttccgcttctgtcttccctttccagacatcgatcaggtacccgatggtctggaacgtgtaaaaagatattccgaccggaagaatgagatccggcacccttaacgcccgcacgcttcccaccgcacggagcaattcgttgatattctgcactgcaaaagcagaatatttgaaaaaaaagaggattccgacacacacaagcacgctgccggtcagcaccgccagacgtctcttcccttgtcgtactttattttgtgccagcaaaagtccgcccccataaccgattgcggtcacaagcagaatcagacagccatactgcacattccagctcatataaaaataatagctcgccacaagcagccataactgttttgccctctttggtatcagaaaatacattcccgtcaccagcgggaaaaacaaaaggaatgaaaacgaatgaaacagcacttaattctcctctcatgaaatcaacagatgcctttcctaaaatcctttgacgcaatacccgtcagcaaattttctcaatccggcgttctttgtatttgcaaaaaggagacacggtcttcacttgccatgtctcctctgtctaatgctttttgttgtgatgttcctacagcatcttaatgcgctctaacgctgccagtgtattctcatagcttccgaatgccgtcaaccggaaatatccctcaccgctcggtccgaatccggaaccaggtgttccaaccacgttggcgcgtgcgagcagatcgtcaaagaattcccaggatgtcatctctcctggtgtcttcagccagatatacggcgcattcacaccaccgaacaccgtgtaaccggcatcccttaatccctgcttgatcgctttcgcattcttcatatagtaagcaacctgctcttttaactgtgtctttcctgcctcggaataaacagcctctcctgcccgctgcacaatgtacggcgcaccgttgaacttggttccgtgacgtcttgcccacatagcattcagcgatacctcaccgcactttaattccttcggaacaaccgtataacccagacgcaccccggtaaaaccggcattcttagagaaactcttcagttcaatcgcacaggtcttggcaccctcacactcatagatggagtgcgccacattttcctctgaaatataagcctcatacgctgcatcgtaaataatgaccgctttgttcttatttgcataatctacccagccctgcagctgatcttttgtgatggtggtaccggtcggattgttcggcagacacagatagatgatatccggtgtctctttcggaaactccggcacaaaattattctccatcgtacacggcatgtagatcacatcgctccacatctccgtctccggatcataagtaccggtacgtcccgccataacattggaatccacatataccgggtagaccggatcacacactgcaatgcggttattctgtgcaaaaatctcctgaatattaccggaatcgctctttgctccgtccgatacaaaaatttcatcaaccgtaatatcgcatcctcttgcctgataatcgttcttcacgattgcgctgcgcagaaattcatatcccagatccggtgcatatccgtgaaaagtctccgcatgccccatctcatcgacggctttatgcatagcttcaataattgccggtgcaatcggctgtgtcacgtcaccgatgccaaggcggataatctttttgtccggatttgcttcgctgtaggcatttaccttctttgcaatcgtactgaaaaggtagcttcccggaagtttctgataattatcattgatcttgtacatgtctctctccttattccttccatgcagaattcgttctctttcaaaatgtcgccaacgacacaacgcattgccactctctgtcacccattatctcatacttaaatccaatccgcaagcactttttgattcctggtaaacaaaattctcctgtctgcgacttttcctattcgcacgggtatgcatccccgcggagcgtttttgtataacaggaacgatatttcctattacaaaaaaaggaccgccgcatctgcggcaatcctctctctcactcatcaggcaagcaaacttaaaatcatctgggctgtttctgtcagaccggttccattatccatgctgcgtttctgtatgtaccgatgcgcctcttcctccgacagattgttacgttccatcagaagtgcttttgcctcatttatcagctcctgttcctccttcgtgcgctccttcggaatctgcttcaacttttttctgcgcctggtgatggtatattccatcatctccaccgtatctaacagctcgtttaccttaagcggcgtggcaaggcagaccagattctccacatcccggtttccacagtttgcaggagacgcaaccaacagcatttcaaattgtaccggcagatattcgtgcagttctgtgtacatcatatccacaaaacgatacccgcacacgacaatcccgccgccaagttcaccggcgctctgtaacacctgcgctccggtgctgcagactgcatcgacatgatgaccgttctgcatcagtatttttttgatattgcgggcattatcctgtttgggaaatgcaacaataatatttgtcaattctatcccctttgcatccaggctctatattttataaaggtaattgtcaatttcccagcctgtcacctgcgcacgataatctgcccactctgccatctttgcctcgctgtacttctcgctgatatgttcgccaagtacttcccgaatgtaaggatctgccttaaatgcttcgaccgcttctcccagatccgccggaagtgattcgattccctgcttcttaatctgcgacagccgcatctcgaatatattctcagtcacggcagccggcggatcgatctgccggcggattccatccagtccggcttccagacacaccgcgagcgtaagatacgggtttgctgccgaatccgggcagcgcagttccactctggttctgctgccgcgcgataccggaatccggatcagcggactgcggtttgtcatggaccatgcgatataaatcggcgcctcatatcccgggacaagacgcttataggaattgacaagcggattggtaattgcagtcatggctctcatatggttcataatgccgccgataaaccagtaagcttccctgctcagtccgttctccccgtccggatcgtcaaaaatgttccgaccattcttggaaagcgacatattcacatgcattccggaaccattcaccccgtacttcggctttggcataaagcttgcaaacatgccgtgccgctttgcaatggtctttaccgcaagcttgaatgtcatgatattgtccgctgtttttaacgcctcgtcatatttaaagtcaatctcatgctgcgccggtgctacctcgtgatgggacgcctctatttcatagcccatatcctctaatgtcagcaccatatctcttcttgcattctccccgagatcaaccggtcccagatcaaaatatccggcacgctccgtgctcatcgttgtcggctgtccatcctcatcctgattaaacaggaaaaattcacattccggcccgacatcaaaacggtatcccatagattccgcatctgccaccgccttctttaaagcataccgcggatctccctcaaacggtttgcggtctgcggtataaatatcacagatgattctggcaacttttccctgctgtggccgccacggaaagattacaaacgtatccagatccggatacagatacatgtccgactcttcaattctcacaaatccctcaatggaggacccgtcaaacatacattcattgttcaatgctttctcaagctggctggacgtgattgccacattcttgagtgtcccgaacatatcggtaaactggagcctgatgaactccacatcctcttcctccacgattcggataatatcctgctttgtgtacttgctcattttcttctcctccatcttccactgccatgatctttcctcactgccgtgatcttttctcactgtcgcggtctttcctcactgtcgtgatcttttctcactgtcacggtctttcctcactgtcgtgatcttttctcactgtcaagttccttcctcactgccgtgatcttttctcactgtcgcgattcttctcctgctatctgcaatattctgtaactttttcaaaaggcatcgatcctccgaacaaatccagtgcacttccgatcgtcacattcagcctgtcacatccaagctctctcaaaagtgcaaggtcatcaaagtcccgcactccgccggcataggtaaccggtatcctgccccaggagccaagcagacttgcaagttctctctcaataccgtttgccttaccctccacatcgaccgcatgtactaaaaactcgtcacactcactgccgaggcgttccaaaagttctgttgtcacacgttccctcgtatctttctgccagcgatcggtcacaatataataaccatccgcccgctttgcacagcttagatccagaaccagatgttcttttccgacatttttcctcaatgttgcaagccgttcatagtcaatttttccgtcacgaaacacataggaggtgacaatcacatgacttgcgcccgcatccagaaactgctttgcgttcgcagcatcaatgcctcctccgatctgaagtccgcccggatactccgcaagcgcctgcagggcctgtgcctttgtcgcctcatagtacgcactgtctcgcgaattcaacagaatgatatgtccgccgcgaagtcccgcttccttatatagatgtgcataatacgcagcatccgctccggcgacaaaattctccactgcccggtctccctcatccgcaagactgctgccgacaatctgcttgaccttgccgttatgtatatcaatacagggacgaaactccatactgcctccttatacactgctctcgtaatataaatttaggcaacgtaccccctgtaacagtggctccgtcgcccactgccatcatagcacacatctgtccgtttgtgaatatttttatatattagtctaacttatcaatatatttttttatcaactgacacttatactacattgacacacacatttttttttgctattatagagaaactaatatacttttttaacaaacatttatacaaggaaagcgaggaaaataaaaatgggaacaattatcggtgaaggaattacttttgatgatgtgcttttggttccacagtattcagaagtaactccgaacatgattaatttaacgacacaccttaccaaaaaggtcgtgctcaatatccctatgatgagtgctgcaatggatactgtcacagagcacagaatggccattgccatggcaagacagggtggtatcggtattatccacaaaaatatgtccattcaggctcaggcagatgaagtcgacaaggtaaaacgttcagaaaacggcgttatcacagacccatttttcctttctccaagccatacactgcaggatgctgaagacttgatgcgaaaattccgcatttccggtgttccgatctgcgagaataacaagctcgtcggcatcatcacgaaccgtgacttaaagttcgagacagatttttccaagaagatcagtgaaagtatgacttccgaaggtcttatcactgctcctgaaggcattaccttagaagaggcaaaaaagattcttgccaaggcgagaaaagaaaagctgccgatcgtcgacaaagattttcatctgaagggacttatcaccatcaaggatatcgaaaaacagatcaagtatccgctctccgcaaaggatgagcagggtcgtctgctttgcggtgcaggtgtcggcattaccggcaacatgatggaacgtgtggaagctctcgtaaaggctcacgtagatgtcattgttgtggattccgctcacggacattccagaaatatccttgaggctgtcaagaagatcaagaccgcttatccggatctgcaggtcattgcaggtaacgtggctaccggagaagcaacacgcgacttaatcgctgccggtgcagatgcggtaaaagtcggcatcggacctggttctatctgcaccacccgtatcgttgcaggtatcggtgttccacagattaccgctatcatggactgctataaggttgcaaaggaagccggtattccgatcatcgccgacggcggtatcaaatactccggcgatatgactaaagctctcgcagccggtgcaaatgtctgcatgatgggaagtatctttgccggatgtgatgaggctcccggaactttcgagttgtatcagggaagaaaatacaaggtttaccgcggcatgggttctcttgcagctatggagaacggcagcaaagaccgctatttccaggaaggtgccaagaagctggtaccggaaggcgtcgaaggccgtgtggcttacaagggcaatgtggaagacactgttttccagctggtcggcggtatccgttccggtatgggttactgtggctgcccaacgatcgaggatctcaaggaaaagagcaagtttgtaaaaatctccgctgctgctcttcgtgagagccatccgcatgacatccacatcacaaaggaagctccaaactacagtattgacgaatagacattttctttatataatgtcatttatattacactttcgtattccggcgccctgtgtgccggaatactattaaccaaaggcatgacacatatatctgtgctcatcctgctatttaatgaggtgaacatacttggattcaagtgacatatttcaaataattttcttagtgctcttacttatgctctctgcattcttttcatccgcagagacggctttaattaccgtcaatcgcatccggatgcgtaccttggcagaagacgggaacaaacgcgctgccactgttcttcgcatcacagataattctggaaaaatgctttctgcaatcttaatcggtaataacatcgtgaatctgtcggcatcctccctcgcaacttctctggcaatcaagatctggggcaatgtcggtgcaggtattgcaaccggtatccttaccattctcattttgatttttggcgagatctcaccgaagacactggcgaccgtcaattccgagaaactggctctcacctatgcaaatgtgattgaggtactgatgaaacttctgactccggtcatttttatcatcaataagcttgccaaccgcatctgcaaattatttggtgttgatccgaatgccgatacccagaagatgaccgaggaagaactgcgcacgatcgtggatgtcagcaaagaatccggtgtcattgagtctgaagaacacaccatgattaacaatgtgtttgattttggcgatgcacaggccaaagaagtcatgattcccagaattgatatgacctttgcgcaggtagacagttcctacgatgagctaattcagatttttcaggaggataagtttacccggctgccagtctatgaagatacgaccgacaacgtgattggtatcctcaatatgaaagatctgcttctctgtcgcgacaaggatcatttttctgttcgtgatattatgcgtgaaccgtattttacatacgagcacaagaacactgcggaattgtttatggaaatgcgtaagtcctctatctcacttgccattgttctggatgagtatggcgctactgcgggtctgatcacgctggaagatcttctggaagagattgtcggtgaaatccgtgatgaatatgataccgacgaagaagatccaattgtccagcttagcgaccgtgaatacatggttctcggctccaccaacctggaagatctctgtgatgaaatcggcttgaattttacatccgaggattatgatacgattggcggctacctcatcggtctgctggatcaccttccggaaaagaacgaagtgattattaccgatgatgatgtgttgcttcgtgtggaacagatggataaaaaccggattgaaaagatctatatcaagaagccggaagctccggtctcagatgcagaagaacacacataagggctgtccgtaatcaacaagaatatattaggaaacattctctccactcttcctcacagaagaatgaaagatctacagccggcggcaggcaggaaacgcctgccgccggctttttttattttcatcttacacgatttggcgcaagatactgatcatacattccctgtaatgctcctgcttctctgctatctccgaatccgtgtgcatctacatactggcggatcttccggcgtgtctcaccattaatcgtataggtttcaaccggtgcatcattttccagattttcaaacgccgtccgaagtgcagacacgtacgcagtatccgtcttccagatcgaatcatccaaaagccctccccgttcataagaacttccgtaatatttttcatcaataaaacgtgtcgttctctccgttcgtacatctgcaggcgttgtatccaccacataaaccgttatctgcttacaatagatactcccggcgctgtcaactaccataagattttccgtacagcttcctccacgcaaaaactgagtaaaatccgatgcctgataatccggaatcgaaaaagatgttccattttcatgaaatcctgcctcgatcgggcttccatcttcacgatccgatgcagtcgcatggcttaaaatctcactgtctgtgatacccccctgctgtgcctgctccagtgtatagtagagatttgtggcaacaatccacggacagtcatcccacgacgcatacagcgtgatcatcgcaccgttctgatctgccacgccggatgcttctatcagatccgccacactgacctgcattcctgctgtccattgcggtataaagctatcgcgcccatcctcgagcgaccaccccataaaaacagccgcatatgcctttttatccgacaccggatcagcagccggagtttccgattcttccagaacttccagttcttccacatccgcttctgcttctgttgcatcttcctccggtgcttctgtcgattcactggaagcatccgcttctactacttccggatctgctacgcttccatctgaattcgtgatgcttccatccagctgcgtaatacttccatcctcatttataatgccacctgccggtgtcatcatcagacccgtatccgcatccatcaccataaccactacgccagaatcatccaaaacaatcgtgccgtctaatacctgctgcgtgatatcctctccgtccaacgtatagcggatataacgtcccgtagcatccggcaacgtcacattctgatcgtacatgatcgttatatcatcaatcggcgcttgttctttgccatcgttcggatcaaaatgcagcgtataactgtttgctgtccaagacgccgtcagaacatctgtcgcatcatcttctgcgccaaacgtatacaccgcattgttcagactaccgttaaatggatccgatttcacccagcccgaaaaagtatatccggttcttaccggatgcagaatggatttagccgttccatagtgctccgtaaaactctgcacagcggtacttccctgccatgttcccccattgggatcaacttttaaagttgagtggttaatctgcgcatttgcagtcattcgcacattttgtacaggcatggcaaacgcatactgctttctatccgtctcatacgtgccagtccatcccgtccaatggtaaccattttttaccaccgcatcaattgtaaccgctgccccagacatataattgcgtacaccactgacactctgaattccatttcctgcaatcagatcaacccggaataaagcattgcaccagctggatgcaatgcatgctttgtcgatccagtgtcccgtgtcaactcctgcagattttaaatacccatcaagttgatccctgttatcaaaccgactcataccggatccgctgatccggcaatagatcgtatactcaatcttatctcccttaaaccaacttgatatgccaccaccagaaaagataaccgtattatgtactgtcccgtccgcacccgtcaccgtaccctgcctcacagtagcactggacacaatattgctatttaccgcaatgttgtaattcgtcagatccggagtcagattcggatccagtgtcaccgtcagttcgccgtcaaaaagaccagtatcatcctgtgcagatgtattttcaatcttcccttttacgataacctttccatccgatatacttgttgtctgctgcgactcaaactccggaaaagcaatgtctaccgccgctccgatgtaaagctgggtatcccaacggacattggcaacatccaccccaaacactgtcgcaccatatgataatcccgaaacgttatacaaaacggagcacatatccgtttgttggcaaaatagtgatccatcacggtaaagcccctctattacagtcccgccgttccttacatttttttcactatcccgagcttgttgtgtaaacatggatatcagtttgggattttccgtaacccttgccgcatcgatacatccaaaaagtatctgtcctgtcacgtctccgtattccttggtttttaaaccatcaaacaactctgcctgcatcgtaacagttgctctggagacaggatcgaaaccataatcatcgccctcccaatcaacatctccgaaccggaatctcgatcccacacttaaagtcaccgcacgtaccggataagaagcattttcctccacgacaatcagctgccagccggtcggcgttccaccgcctcccgtatcctgctcccagagatcggatgcacggcataccggtatattggctacatagtaatcaccatacccgtatgttttaacgatagttgttacatccgcaacgttgcagtaaattcgggggcgggactgctcccatccagaaacataccgcgaactgcgatcgtctacatagacccaatcaggataaatgtttgctcctgatcttccgtcgtgcatgatgaatgttacatgatttgcattactatcatctttgttatatctcttccgagtttcccatatcaaatatgcttttacaatatgagtcgtgttattatcaccatgtagcgtcgccatcgaactattagaccatcccagtaacgtctgactacaataagattcatcatcatatctcggtgacggtgaggaatagacatttatattgcccgtgtaattcaaagcatatctgcctaccgtagtattctcatcattttgtcctactggcaaaacattaaatacatttttttgtatctcacttgccgcgccttctgccaatgttcccgccataactttatcagaaaataataacgcacttatcacaaacaatacgcataaaataatcttatatattgtacttctgtcgtatctgagcttgcgctcactatacatataattatcctccgttatatctaattaaatgtgatcgtggaatttcccccgccatttccgccagtcccggagttatctccaagtgacggatctagtgggataaaatcatctggaactgacatcgttccatctgaacttgaatttccaccgttgttgcttccagtgtctgcacttggtgtggagcttccagtgtcggtacttccgctgtcaccactcggcgttgtgcttccattctcgctgcttccggtattattgcttccgctgttgctgcctccagacgttccactgttgctatttccggaattgctacttccagatgttccgctgttactgtttccggaattgctgcttccagatgttccactgttgctatttccgaaattgctgctttcagatgttccactgttgctatttccagtattactgcttccagtatttgtagcactgctgttggttgatccggtttcagcctttgttgtctccgactttgttgtagcagatttggtatccttcttagaggtctttccatctgcaactgtcaccttagcagtctgctttgcagtaaacccgttctcatctgttaccgtgtaagtaatctcgtactctcctgccaaagacaggtctactttgctgtcatcacattcgatcttatctgtcagatcattcccattgctgtccgttgccgttacacccgaaagatagtccacattctctgctccggttgttacggtaagatcctcaattcccaaaaatgtcggttctgtaccaaccagtaccggcacttctacctgcttgctatttccactctcatctgcgagtgttaagcttacactgtactcccccactgtatgaaagactatcgcgtcatttgttaccgttacatcgtctaacacaaatgtttccatatcttctgacgctccggtggcctctacttcctcggtgacctccatgtcctcagtggtctccacatccttggcagcctctacaccctcggtagcctctacaccctcagtggtctctactttctcggtggcatcggtagactcatctgccagatcgtcaaatgttgccattacattcccggtcagctcggttacactcgttaaaacatcctccacgtacaatggctcgtccacaccgactgtaacctgattcaccacctccgcctccggcgctgtggtatctactacgtccacttcaagggacgctgtctgatccttataagtaaccactgccgtataagttccaagcttacttacatcaaccgccccaaaatcaattgttgtctccactgcgatatccgcatccgccacataagccgctacatccgtattaagctcataccccagttcgacacttaccctatctgttgcaagcgcaagctgcttatctccgcaacctgctgctgtcatttctgtcaccattgttactgttaataatactactacgcttttctttttcataaactaatctccctgattcttataatttccttttctgtctttgccgcttccctttaaaaaacttcattcataaatgcttccaccagtttctcatagctcctttcacttgaatccaattctttgaacacttgccatacaaatcaacactttcgttcgcttttaaagaggcatatctactactacattagtatacactacacagtacgttttttctatatttttataatctcagctacgcttttaatgcttccctctatcacttccagttaaccctctttttaccgattctctctgtagatcgtatcatcgcattgataatatagtctacaactgcctgtcatgatccggtgccacgatctgcaccatacacatttgccgtattccctgcaattcccatatctattcccaggcggcataataatcacgattttcttctatcggctgtgaaaagtccgccgcgtaatcattccagtcatgccagccggcaaataccacaccattgcctcccggttctgccggtggctgcagacattgtccctcctccacggtatatactttataacagcttccctcaccgagcattccctcccggttctggtaaaaccgcacccggtactgctcttttgatacattctccctctcttcccggataattgttctgaccgcttctgccgtaccttccattccattgggatgttgaaacttttcctgtaatttcattgacaatacccccttttgcacatcattctgatagaccttcaaaaccacatcggagtctgtatcgatttccgccgccagaagttccacacactccgcaatcaccaattctccggaagaacaccccgcctccgcaaacggcatcccctcgaccgtcttttccattgtggaaggaagaatcgtctccacctcacatctgcggttcatgcttccgccaatcgtcagcacaatcccgagtatcagaaatcccatgattgcactgacaatgatcatcgctgcatttttcacatatatctcctttcccggctttctgtcttctcatcggttcacaggtatctgaaactcacagacgcttctgcggtttgcttcgtctgtcgcgcagacccgcaccgtatagatcccctccacatcaaacacaacctcaccttgctgtgattctattgtgcagctgtttccatgcggatctgtcatctcacaccacaaaacactccgttcttctcccattccgtctaccgcagaaaataagtctcccggcagatatgctcccctgtgcagcataccattgtacgcataccggatcgtggggtacgccacctcccccgcctccgcaaaagcgtcaatggcagcgttttctgtgattgtctcttcctccggtatccatgtctttacgatgttaataattccccggttgccctgctcgtcacgaattcctgcaaacagcagtaccatgactgctatcagcacaattcctgccgcaattccctttccatagcattgaagtacctgctccatctgatcacctctgttcttttcctgttggacacttaactcccacagattcccgtcatataataccgcaggaccataccgatcatcccctgcccatccacggcatggaagaataagagcaatgcccctattccgcctgcaatctgcaaaaatccattgccataaacctctgcgatctctttcatctgtacgctccttttctctgacacgtccgggcacgaaatccccctatagcatgccagccacctgcatccatatctcctgaattgccgtgcatccaaaccagcccaccagcaataccagcattgtcattccaagttcttccagactccattgcatcctgctcctccttttaccgtgcgattcctctcgtcacccgctgctgcgagacccctaacagtggtatccggtatctataatagagattgatccccgcaatcctgcggtcgctttgtccaccgtaggtgtaggactgcacttccagttcgtacccttctgttcctgcctgcgccttgcagccatcaatcacgtacggattaaagtcactgttctcaatttctgcaatcattgcagctttaaattccttcgccgctgccacatcggcactcaccccgagcatactgatgcacagcagcagattaaaaaccagcaccagcatcacactgaacacttctatgatatatttcactcacgcacctcccatgcctccaagaacctgcatcatcaacgccattccgaccgtaagatctgccagcagttttccagtggctgccagcaccggatatgcaaaaatcaacttcatccggaatgcacgctcttcactgcgcaaaacatcggcgcgctcctgcatcagaaccacacgctcaatcagatgattcatctgcacatcaatatctcctgttccgttttcagaaaaagcatgcagcattttcatacagcttaacatctcggggagatcaaactttttgcaaaagtccgtgtatgtctgtaattgatccggacgctcgtccattctcgcgcaaagctccgcaagttcgctcccgagcaccgccggggcatgttgtgcagattttgtaatcgccatctgaacgttattgttctgtaaaagtaataccatctcaaaaagccagcgcggcagcacctgatacaattccgccgtcacgtcccgctcggcaatgcggtaactgattctcggctgcattgcaaccagtaaaccagtcaccagcaggagtattcccgcaatgcgccatcccacagtccaaaacacaaacgcagtcatagtcacaattcctgcaggaatcaggcgccgatactgctgtgctttcttttcataccccattaccagttcatagctgtgtctgatatatgccgtgtcatacagcggcttttcctccagccagtcagccgtcaggcttctgacactcttcacataaaatgcaagcagcaacaaaagaaacaccatcgaagatatctggatcacaggaacggtaaacaccgatacgtcaacctctgatgtaaacatctcctgcatctcatttaaaagatacaatgcagccgcgcacaagagcactgccaccacaatggaaatcacattatctgtatgactcttccgcttctccgcctgaagctggtatccacgctttttgaaccgctcaatatcctccagaacaagcgtgaccgatgcctccacatccccgccatattcctccgtattcagtagaagttcatgtaccgtcgccagcttatcacaggcataataccgttcgattttctgtaaaccctcacgcagaacgccctgctctccgaccggatgcccgtactccatatgcgcaatcgcttcctccacacagagtcggatctgtccttccccaaaaattccgcgcacctccttcaatgcactcacgatctttccggtcttctgaaacgcatagagcagctgttccatgtaggcacatgcatctccaaaacgcttctgctcatacattttcttatacatatcaagtaccagtaccgggaatacgaaaagcactgtcaaaagcacccctgccaaaaacagcggttttagctgaaacaccattccaatcccaccgattccaaccagagcggctatcaccgccataagatgcgtcctccacgaaaaacgataaccgtacacatgcacttcgcgctgcagatttttcggattcaacagccgcagtttctcccacagtccttctcttttcatctattttccctctctcctgtatctctgccagtgtgcgcagcaaaacggatcctctattcccgcctgtccaaggcgtctcacaatcgcaggcggaagctcttccgagagcagttccccatcctccagtatcatataaatacgattctcatactgctccctgctgtaaaaacacagctgatccatatatcttcggatctttccgtccggctgtctgacgcagcggatcagaatccccacattcacatagcggtagatccggttctccatacgctctgcgtcacgcgcatcgctcatcatattctgaatgcgatccggaagctttctgacatcatccaggtggatcgtcgtaaagccgctcacgccggtactccactgctcgagcagcgacgtcacctccaccgaccttgcctccgagaggacaagccacttcggattctgccgcaggctcgccttgatggcatccgtgtaggaaaaatcttctccgacacgaagctccaccgcatccgcccccggattgatgtcccggtaatggatctcgagcgaatcctcaatcgtaattacccgctcctcgcgcggtataaactgcataaagaatttcgcacactccgtctttcccgcaccgggttctcctccgaacacaaaattcatgcccgccaacacacagttcatcaaaagctgtaaaatccgttccgggcaataggattcttccagcattctctcaatgttcatgcgcaccatgctcggcgacttccggatacagatactggtgccggatgcggccgccgcctcatggataatactgatacgcagttctctggtatcagcctccagcaccttattggcattattgaactgacgattcacgcagttggaaatattgtgcgtaaaagtgctgataaatgcatcggacagatgctcttttacacgataccttccgatctttaagtccgtaatccacaattcgcttccgttgtagtccacatcggtaacattcgggcgctgcagatatttccagaaaaccccaaactgcgcttccgttggttcaaacgtcatgatctcccccatgtcatcctccctatggcgttaagccattcatgcgggaaaagaatcccgtcagcgcattcttgaactccgtcgccacatatccgtccgaggagagcgccgcaataatgattgcgccgagtgcaagcaatacaataattgcaaggattgcatttccataatgtttcattacctgttccataataatttcctccttcacccttctgttgtgtctttttcttttaccaaacatgtccggttttatcgatcttacatacctcccttaaaatacgatccgccgcttttactaatccatcgataaactcctgattcctgctgcttctcgcagacccgtattcctccgctataaaagagctgcccagtccgcgcttcaatgcacagtcatacgctgcattgtaccgcacgatgccaatctgcccctcatccacccgatatactctgtttagcacatccggctccggtgtcccgatgcagttggcatacagatacaccatgcgcttctccagatacatatggcgcaaaaagaactgctccattccgtcgtaatcctgcggttcaaaatttaccaccacaagatccgctgtcaaaaggagcttcttttgacccgccggactgcacactcccgcatcccacaaaaagagtgccgaatcctcgcatcgctccctctgcaggctgccgcacacaatcttcctgtccgggcataagtgcggcaaaatgcctgccattgcagtatagttcgccgtcgtaccgctccggtgtgtttctccccaaaatacaatattcatttgttcctcacttcactctgtgctgtgtgattgtccttactggaattatggatgaaactgcctccatatagcgtgatacttagaaatgtggataaaatccaactatttgataaaagatgtgcttattttacatcgttttcttacatatgtaaatagcatttttcaaatttatattttttttagaaattactaccggaaacttttcttttcgcattgcttccattataataaatacaaatacatgtatcaggaggtcttatgaataattttatcattacaaccgataccacatccgatcttccggctgcctatgtagaacagcatcagatcggcatgctttctcttacatatacgattaacgatactacttattcttgggagcatccgcttccggtaaaggaattttatgactgcatgcgtcagggttctcttcccacgacctcccaggccaatcccgaggaggctgccgctgtttttgaaaaaataatcaacgaacagaatgccgatattcttcatatcgccttttcttccggtttaagcggaagctacaacagcgcaaggctcgcggcggaggagctttccgaaaaataccccgaccggaaaatcatcgtcatcgattctctctgcgcttctctcggcgagggacttctggtgcacaaagccgtcaccttaaaggagcagggacatacactggaagagaccgcagactggcttgagtcaaacaaacttcaccttgtacataatttcaccgtcaatgatctgtttcatctctaccgcggcggccgcgtgtcaaaaaccgctgcttttctcggtacgatgatcagtttaaagccgcttctccatgtggatgatgagggacatctgattccgctctccaaagtgcgcggacgcaaaaagtcgctgattgctctcgtggatgccatggaaaaacagatcggcagctggcgtgacaagaatgacatcattttcatcagccacggcgactgcattgaagatgcacaatatgttgctgatctcatcaaagaccgtttcggctatgaaagcttcctgatcaaccatgtcggtccgaccatcggcgcacacacgggtccgggcgtcgttgcactgttttatatgggcgattaccgttaatcggaagcgccttttttgtggaattgtcgcaataagcatagatctctttgggttgataagtaatattatcagaaacacacttcgggatttcatgtggaaatgcagatggaatatttgtttgagaaaaatgtgagaatttctttcagctgaatgtctgcatcggattccgtgtcgcttccacgtttggacaatccgacgggtgcatgtccggcacaccggagacaatgggcggactttctggtgtccctaatggcacctcttcacagacaatataaaaccgcgcgaaccgaactcgccggcatctgctattgaaaatagggcagatgccgcctcagacagcggcttcgcgcggttatgttttgttcgacataaagatggcatttatgccatctgttgtctggtgccgcaagggacacacacaaaagtcctacaaattgtcttccgggatgcggacatgacccgcggagtgctccaaacttggaaagacacggatcatcgaagatgcagacattcggctggttagaaattccatattttttgaaccgaatttccatctgcatttccatctgaaatcccacggtgtggtcttcttataatattacttatcaaagcaaacatgatatgcttattgggacagttccataaaaaaacaggccaaagcaccacggtgctttgcctgttttttagccacttctctattatacgttgatctccgcctttacgccgagttcgtcctgattcttctccaataccggatttacaacgtttgcaaggaatgcatccacctgtaccggtgcgcgtccgacatacttggacggctccatggttgcctgcagctgctctaacgtcagattgaactccggatctgccgcaatcagctccagcagattgttgtccttaccctcttccttgacattctttcctgcctgcatggacagctggcggatcttctcatgcagctcctgacggttgccgccgttcttcaccgcgtccatcataatattttccgttgccataaacggcagttctgccatcatatgctttgtgataaccttgtcatagaccaccagaccgtcgacaacatttaagcacagatccaggattccgtcgatcgccagaaatccttccggaatagaaagacgcttattggcagagtcgtccaatgtacgctcaaaccactgggttgcagaggtgatcgccggatttaacgcatcgatcatcacatagcgggaaagagacgcgatacgctctgaacgcatcgggttgcgcttgtacgccattgcggaggaaccgatctggttcttctcaaacggctcttccacttcttttaagtgctgcagcagacggatatcgttggacatcttgtgtgcacttgctgcaatgccggcaaggatatttgccactctggtatccacttttctggaatatgtctgtccggataccgcatagcactccttgaatcccatcttcgctgcgatcatcgggtcaatcttatcgatggtctcctgatccccgtcaaacagctccaaaaagcttgcctgcgtaccggtcgttcccttggatccaagcagctttaaggtgctcatcacatattccagatcctcgagatccatcaaaaactcctgtgtccagagtgtggcgcgcttgccaaccgttgtcggctgtgccggctggaaatgcgtaaatgcgagcgtcggcagattcttgtaagtatccgcaaactttgccagttccgcaatgacattgaccagcttcttgtgcaccagctttaacgcctcgttcatgataataatatccgtattgtcgcccacgtagcaggaagtcgctcccagatggatgatgcctgcggccttcgggcactgctgtccgaacgcgtatacatggctcatgacatcatgacgcaccagtttttcgcgctcttttgccacatcataattgatgtcgtacacatgctctttcatctcgtcaatctgttcctgcgtgatgaccggctttccgttctcggaaagtcccagctccatctctgtctgggcaagtgcaatccacagctttctccatgtggaaaacttcatatcctgtgaaaaaatatactgcatctctttgcttgcataccgctctgagagcggacttgaatatctgtctgtactcattttttctccttacctttatccataggcttgctgcattttctaaaattcaagatatcctgccacctgctgcatttccctttgctcccggcgcccctgccgcttgctgcattttcctcgaatctaaacttttctgctgcctgccacattcttctatattttcaagaagctttttacctctcgtagtctcccctgatatcttccttcggcggctccatcgggtaaataccgttaaaacatcccttgcagatcggcagtccgtctgccatctcactcagacggtcaattccgagataaccgagcgaatccgctccgatgatgtcccggatctcctcgatcgtgcggttgtacgcaatcagctgttcccgctccggaatgtccgtaccgaaatagcacggccataaaaacggcggtgaactgatgcggacatgcacctccgtcgctccggcatcccgcagcatttttacaatgcggtcggatgtggttccgcgcacaatcgagtcatcgatcatgataatgcgcttgccgtccaccgcctcttttaagacgttcagcttcacgcggacgctggactcacggctgctctgcttcggcttgataaacgtacgtcccacatagccgtttttgacaaaagcggttccgtacgggatgccggactgcagcgaataaccgagcgcagcggcattgccggactccggcacgcccaccacaagatctgcatccaccggcgaatccatcgccaggaaccgtcctgccttgatgcgggatgcatatacgctcacgccgtcgatatggctgtccggtcttgcaaaatatatgtactcgaaaatgcatctcgcttcctgctcctttggcagtgcgcgggacagatccgagacaattccattctccggcgtgatcgtcaccgtctctcccggcagcacgtcacgcacatactccgcgccgatcgtatcgagtgcgcaggtctccgatgcaaggatataggcattatcgcgctttccgatacaaagcggcttaaaaccatagggatcccttgctccgaccagctttctcgggctcatgaccacaagggaatacgctcccttgatcttgcgacaggcacgccccactgcttcctccaccgtactggatttcagacgctcccttgcgatatggtaggcaatcacctccgagtcaatagtggtctggaaaatagctcctgtatactccaaatcatgtctgagttccgccgcattgatcaggttaccgttgtgcgccagcgccagagttcccttgacatagttgagcaccaacggctgtgcgttttctctggtcgacgcaccggctgtcgaatagcgcacatgccccacgccgatatccccgtgcatgggctctaaattctcctcggtaaaaacctcattgaccagtcccattcccttgtaggaggtcactttccctttcggaccgttcgtctcgctgactgcaataccgcagctctcctgtccgcggtgctgcaatgcaaacagtccgtaatatattgtggatgccacatctccgccgtcaaaatcgtacattccgaagacgccgcactcctcatgcagttcatcccccaccggctgatttttattgattctattatcgctcattgatttccccatctacgaatctgatattctgtctttttatgcctgaaacggctttccggtaagaagctcaaatgcctccttgtacttggccacggtcttctctaccacctcctccggcagaagcagatcgttgtccggatttgcctttaaccagtctctgacaaactgcttgtcaaaggaaggctgaccttttccggcttcatatccctctaacggccagaatctggaactgtccggtgtcagcatctcgtcacccagaacaacgttgccgttctcatccagaccgaactcgaattttgtatctgcgataatgatgcccttgcttaatgcatactctgcacactttttgtagagagcaatcgtcttgtccttaatctgtgctgcgtaatccgcacctttgcccgggtagatcttctccagcactttcacgctttcctcaaaggagatgttctcatcatgcagaccgatctcagcctttgtgctcggtgtgtagatcggctccggcagcttgtcggactctaccagtccttccggcagtttaataccgcatacggtgccgttctcctgatagcttgcccagccgcttcctgtaatatatccgcgcacgatgcactcgatcggaagcatctcaagcttccggcacatcatgctgtttccctcaaaacgttcctgccggaaaaattccggcatatcctttacgtccacggaaatcatgtggttcggcacgatatctttggtgtaatcgaaccagaacttcgacatctgggtaagaattgcgcccttctttgtgatcttattctttaaaatatgatcaaaagctgagattctgtctgtggctacaataatcagactgtctccattatcatatacctcacgtacttttccctcttttaccggcttaaattcctgcatttcatcctcttttccgaagccttcccggcttcttttgttgatatttacagctttacccacttccgcagactatttctgcactgtacttcaaaattataatacagccgcttttggaaagtcaatgtttttacccgctcacaccatttctgcgatatagaaaatcgagttctttttattagtatttttgtacatattcattatttcattagcgtgacttataggcttgttcacacagcctaattcatattttgtcttaaaaaaaatacatgtttctcccttgacgtactttagtaccagagttataataactgcgtagataggacaaaagcactacttttgcaattatctaatttcatataactcctctttatctgccaccagggcagatgttccagaaaacggtccccccgttttctgaatcctaacacaagaaaagcagcccctcccccgggactgcttttctcgttctattctttattttctgaccagaagtgactttcctgtcatctctgccggctgctccattcccatcagttcgattaacgtcgggataatatctgccaggcatccgttctctctgagtgtgtaggacggatctgcattgaccagaataaacggtaccggattcgtcgtatgtgcggtaaacggtgcacctgtctcgtaatccaccatctgctctgcatttccgtggtctgcacagatgaacatctgtccgtctacttcctttaatgcctccactgcctttccaacgcaggtatctacggtctcgattgccttgatggctgctggaatgataccggtatgtccaaccatatccgggttagcaaagttgatgacaatgacatcatacttttcggaacggatagctgcacaaagcttctcacacacttccggtgcgctcatctccggctgcagatcgtaggtagccaccttcggagacttcacaaggatacggtcctcaccaacgttcggctcctcaacgccgccgttgaagaagaatgtgacgtgcgcatacttctctgtctcggcgattcttgcctgtgtcatgccgtgcgctgccagatactcgccaaatgtgttcttaagctccactttcttgaaagcaacttccttgttcgggatcgtcacatcatactcggtaaagcagatatatttcacattctttctcgcgcctctgtcaaatccgtcaaattcatcggcacagaaggttcttgtgatctcacgtgcgcgatccgggcggaagttgaagaagatcacggtatctttgtccttgatcgtcgctaccggcttgccgttctcggtaatcgcggtcggtacgaagaactcatccgtcacatcctttgcgtaggaagcttccattgcagcaacagcgctctctgcggtctctccctcgcccttggtcagcacatcatatgccttctgcacacgatcccagcggttatcacggtccatcgcataatagcgtccggaaatagaagcaatcttaccgatgcccagttctgccatctttgcttccagtgcctcgataaatcccttaccggaagtcggagccgtgtcacgtccgtccaggaagcagtgtacgtatacattctttacgccctgtctcttggcaagctcgagcagaccatacagatgtgtaatatggctgtgtacaccaccatccgaaagaagtccgtataaatgcagatcagaattgttctccttcacatttgcaataccgtcaagcagcgcctgattgctgaaaaattcgccgtcattgatctctttggtaatgcgtgtcagctcctggtatacaattctgcctgcgcccatatttaagtgtcctacctcggagttacccatctgtccgtccggaagacctactgccagtccgctggcatttccctttacaaatggatattccttcatcagtgcgtcgatattcggcttcttcgcctgtgcaacggcatttccttccgtcttatcgtttaatccgaatccatccaggatcatcagtactgttggttttttactcattgttcttccctctctctttattttcggttgccaacaatgtcgatggcatacccatcattatctgtcgtgccgcggatctttgtcttgcttgtatccgaatcgtacacgattacctgcgaaggataatcccccgctgttttatcataaacattaccgtccgcatccattccgatgtcatcggaaattgcagccaggtaatgataaaacccgtctttatcatcctgctctgtcagaatgcttgtaactagtcccttctgtatacacgggacataggaaagtgtcaccgcgccgtcctctgtgatcgtaatcttggcaagcgttgtatacagcgtcccggtggaaaaccagaaatttccgagactgtacgcaaccggcacaccatcggtaaaaccacatccctgcagccggtgcggatgtccgccgatcaccgcgtctgcgcctgcctccgcatatagctccgccagaagacgctgggatttttcttcgtgcagactgccttccgttccccagtgcacttccacaatcacataatcacttgtggcgtccgcttcccggatcacctccagaaatgcggcaggattcaaggtctttaatactcccggttccgtctccgtcgcctcttttgtatacttggtcgcccgctcaatctgtgtggcggaaacaatggcaatctttctgcctccgatcacaaaagagaggatcttggatgcctcttttcgattctcgcccgcccccgtataagggatgtccgctttccgcagacaatctaaggtcgacagcagtccttcttccccgtaatcatacacatgattgttggcaagcgtcacagcatccgttccaaaaacagagaggagttctacatcctccggatctgcccgaaaggtatatgccttcccgggaaccgcctccacgctcccgctctctgcgtaggtgaactcattgttcatcaccatcacatccacgttctgcatctccgagagcagatcctccgaaaagcagtcatagatgccattcgtctgccggttcatatactccatcgtataccagtcgtcggcaaaattgatgtcacccgcaaagccgagcacgatctttccatcctctccggcctctttccagtatacattttgcagccggtactgctgaaaaccactgtccctgcaatacatcaaccacagtacatggatggagctgccggtaatgtcataccagacttccggatcctccgttccatccagaacggcactcgcgatccgcactaccttctcatctccgtatctggcagccagccacatcaaaaacgaatcatcgactgcatatcctgcgataaatttcttcgtcgcaccttgtaatatcactgcaaatgcgtctgtcaggtccattctctgtgttgcgctctctgtcatctgcgtacgttttgtatctccggcattccaggtcttctgttgtgccggaatattctgtcctcctgcaaaaatatctcccagaagtacagccaccacggttactacaagtgcatttctttttcccttgcactttttgggcatacattttctccgctgtcactcaaaattctcttatattaccacttacaaattttcacgaaaacccgtctctctccgcctgttaccgcagagagaagcgggtccccgttccatgatcgtaccgctccgcagcgatcctgattccctgtaattttaaactattacttatagtttacaatctttccaaagtcagcctttaaggatgcgccgcctacaagaccgccatcgatatccggctgtgcgaacagttctgccgcatttcctgcattgacagatccgccgtactggatacgaaccttctcagctgtatcggtatcatatacctcagcgatgcagtcgcggattgccttgcagacttcctgtgcctgtgcggttgttgctgtcttgccggttccgattgcccagatcggctcatatgcgattaccatggaagcaacctgctctgcggtaatatcctttaagtccgatttgatctgaagacggatccagtcaagagtaacgcccatctctctctgctctaatgtctctccgcagcaaaggatcggggtcagattgtgctcgaatgctttcttaactttcttgttcagcatgcagtcgcactctttgaagtagtcacgtctctcggaatgaccgatgataacatacttcacgcctgcgtctaccagcatctccggagagatctctcctgtgtaggcacctttctcctcgtagtacatattctctgcaccgactgcaacgttagtacctttgactgcctctacaaccggtacgatatcgattgccggaacacagtatacaacttcaacatcatcacttactacaagcggctttaactcttctactaactttactgcctggcttggagtcatgttcatcttccagttgccggccacaattttctttcttgccattttaaaatcctctttcccttaagaatgatcccatttatgtatctgctgccacgacgttttgtaccgtcacgacagcaggattttgttatttatttgtcgtctgctgctacaacacccggaagttccttaccctctaagaactctaaggatgcgccgccacctgtggaaatatggctcatcttgtctgcaaaaccaagctggtttactgctgctgcggaatcgccgccgccgatgattgtggtagcgtctgtctcagccagtgcctttgctacagcgatcgtaccttttgcaagtgtcggattctcgaatacacccatcggtccgttccatacaacggtctttgctgtcttaacagcctctgcatataactcagccgtcttcggtccgatatcacagccctctctgtcagccggcatattcttaacgtcgcaaacctcaacctcaaccggagcgtcgatcgggttcgggaaatcagcgattgtcactgcgtctaccggaagtaacagcttcttgccaagcttctcagcctttgccatcatctccttgcagtagtcgatcttgctgtcgtccactaaggatttaccgatctcataaccctgtgcctttaagaaagtgtaagccataccgccaccgatgatcaaggtatcacacttctcaagcaggttggagataacgtttaacttgtctgcaacttttgcaccgccaaggattgcaacaaacggtcttaccggattctcaactgcattgccaaggaatgcaatctctttctccatcaggtagccgacaacgttggaaccgccctttgcgctgatgaactttgtcacgcctgctacggaagcatgtgctctgtgggaagaaccgaatgcgtcgcatacgtaatcatctgcaagatctgctaactctttgctgaactgctcgccgttcttggtctcttcctcgccgcggaaacgtgtattctgaagtaatacaacatctccctctttcatagcctctaccgccttggtagctgcctctccggttacgttgtaatcagatacaaatacaacttccttgccaagcttctcggaaagtctctttgcaaccggtgctaaggactcgccctcgtttggtccgttctttacttttccaagatgggagcagaggataaccttgccgccatcgttgatcagcttctggattgtcggaagtgcagccacgatacgggtctcatctgtgatctcgccattcttgagcggtacgttgaaatcgcatcttacgagcactctcttgccttttacattgatatcatctacggattttttgtttaatgacatatgccatgtccccctttaatatgcaaaatgtcaaaaagggacccggtccataaaagaccggacccctttctgagtctatcacgtgattgtccgagaacaatctctttctctcaattatgctaactcggagaagtatttgatggttcttaccatctgagatgtgtaggagttctcgttgtcataccatgaaacaacctgaacctcatactgatcatcagatacctgatttaccatggtctgagttgcatcgaataaggaaccaaatctcataccaacgatatcagaagatacgatctcatcctcgttgtaaccgaaggactcgtttgctgctgccttcatagctgcgttgatgtcttcctttgtaacgccggctttcttaacaactgctgttaagattgtggtagaacctgtcggggtcggtacacgctgtgcagaaccgatcagtttgccgtttaactccggaataacaagaccgattgcctttgcagcacctgtgctgttcggaacgatgttgactgctgctgcacgggatcttcttaagtcaccctttctctgcggtccgtcaagagtcatctgatctcctgtataagcatggatggttaccatgataccggactggatcggagcgtatttgttaagagcgtctgccatcggtgccaagcagtttgttgtacaggaagctgcggaaatgatggtatcagaagcctttaatgtcttgtggttggtgttgtatacgatagtaggaaggtcatttcctgctggagcagagataacaacttttctagcgcctgcgttgatatgagcctgagccttctccttggatgtgtagaaaccggagcactctaatacaacgtctacttttaactctccccatgggcagttatttgcatccgggaatgcgtagatcttgatctccttgccgcatacgatgatggaatcgtctgtagaagatacctcatctgcatgctcgtacttaccctgagatgagtcatactttaacaggtgtgctaacatcttcgggcttgtcagatcgttgattgctactacttcatatccttctgctccaaacatctgtctgaaagcaagacgaccgatacggccaaaaccattgattgctactcttactgccatttttaattcctcctagaatttgtaaatgtaatcgccgggcataaatcccctggaaccggcaagcacaaggtacttatgcttattggctccgtgcttcctatattctaaccaatttccatagaaagttcaagcctttttctccactttattgccactttgttaaatttttcactatatcacaggttttttttcccttttccggaaaaatatacaaaatctgaaaatacgccggaaaatctgctgacgctgcacgcccgctgtgttatacttttttctggtaacctgtaaacataccaaagaggagttttcttatgtcagaccttatttttttactgattttgtttgtttttgttcttatattatccgcgacgccgctgtttcgcaaaagccgcagccagcgggattatgagagttccggcatgcagctgcttgccacttcccgcggcagggtcctgctgctccctgccctgggctgtctctgcgcgtgtatcgtcacattttttatggtgcttatgtatcaggacatcggttttgaggcatcggatataggctctctgctctcatgcatcggcatcaccatcctgttagttgtcgtctgctttctcggcggttacgccatgcaggcacgtcatgttctatataatgaagaaatccttctgatcgggaaaccgttccgcccctaccagaccattcactggtatgaaatctctgagatgcggatcaaaaatcaggacttttttgatctgtatgacagaaacggccgccgctgcgtcagcgcaaatgcgaatctggaaggctaccggcaattttatcaggcatcgttacggttcacccgtcccgaatacaccgcaaagcaaaaaagcaccccgtacgacaatccggtgtctgcggcatccggctgcggaacactgcgctaccggaccggcgaatattacgcgctcctcatcctctatgcggttgtcatgtttctgtttttcggcttgaccgttttttccggggaaagcatttcgggaacgctgcagatcatccgcgaagaaaagctctacggcgcccttttctttccggtcgcgtttgtcggcaccgttctggcactgttttatgtcagtctgcagaaaatcacctacgaccgcgaaaaaattgttatttcccgtttcccccgccggacacaaaccctgctgcgccgggatatccgccagcttgaatgtacctccggcagtcaggggctccggacgcttaccctgcacacagataaccgcagatatgtgatccgcgagaaacagttccgcgtagggttcccggaatttttcaacgaactgatccattaaactcacacagaaaggaagatctctatgttatgggatacacatatgcacagccaatattccggtgacagcgacgccccgcaggaggacatgatccgcgctgcaatcagggcaaagctccccggcatctgttttacggatcatctggacatcgactatccggacaacccggaagcgttcctgttagacctgccgaactacacgtcatccgttttcgccatgcaggaacagtaccgggatcagatcagcgtgcgctacggcatcgagctggggctccagccgcatctggcagcgctgcatgccgatattctctcgcagtatgacttcgactttgtcatcggttcctcccatgtggtacacggctatgatccgtattttccgccattctggaagacgcacaccgaggaggaaggataccgcgaatactttgagtccatcctggaaaacatccgggcatttgatgactttgacgtctacggtcacatcgactatgtcgtgcgctacggtccgacgcgcaacgagaattatacctacgccagatacagcgacgtgatcgacgagattctaagacttctgattgaaaaagggaaaggcatcgagatcaataccggcggcttcaaatacggactgggacatccgaacccctgcgaggagatcctcgcgcgctaccgtgagcttggcggtgagatcatcacggtcggcgcggacgcccatgccccggaacatgtcggctttgcctttgagaaagtgcctcagattttaaaggacgccggttttatttactacacggtcttccggaaacgcaagccggaattcataaaaattgaggactgaccgccgcatccggcgctccagtcctcattctcactgacattttatacgttgatgtcctgtttttatttacgcatctcttctgcggcgcgctctatgtaaaaatcaagcagttcatagatccagtctttcagattggaaaacacaaatcccgtacgcccggcgcgctctgtattgatgctgtagccgggcgtcccattatatggcgccggatcgccggtctcatcaagaaacgcctcttttccggtgcgtctgtacacgtaagtcaggatctcccgcggcgagatggtcccgcggctcgctccgttgacggcaccctggatctcatccccgccgagatgcgccagaaggcgccccgcatcgtccacgctgataaagctcatctgtgcgtccatattatcaatatacatcggtttctgccgcaccacatgttccacataaaagtacagccggtccgtgtagtcatccctgccgatgacgtaggggaatctcacaaaagccgcatttttcatcggatactgctgcacgagcgcacattccgcacttttcttcaatacgtcatacgatccgctgtaatccgtataccagaccagtctgtcatgttccggctcatagtccgtctccacggtctgaaaatgcagatcatacacggatgccgaggacaccatcacataccttctgcagggcaccgcctccagcacggtgcgcacatcccccgcacagtaagccagatcgtcgtagaaaacgtcataatatttatgggcaaacacctgctccatctgccggacatccgtccggtcgacgatcagacgtctgactctgtctccaaaatcatccggcgtccggccgcgtgttgcgatcgtcacctcatgtccccggtgcaaaagttcccacaccagatgttttccgaaaaatcccgttccgcccagcactaaaatattcatacgtttctccatctttcttcttcccgttttccgttccctttcgcactattatactcattttgcgttgttttatcaacaatcccccaagaaccgaacggcaaaagaccccgcagaaaggtttttctcctcgctgcagggtctcttttacttcccgttattttttcttttacttaaaatattccacgccggactcaaacagtctcaaatcctgctcaccgtaaatattcatcgccacactccggtcacgacgctccgaatgtgccatcttgccgagcactcttccgtccgggcttgtgattccctcgattgccatgtaggagccgttgacattccactcctcatccatggtcggaacacccgcctcgttgacatactgtgttgccacctgaccgtttgcaaacagcttctccagccattccttcggagcgacaaaacgtccctcgccgtgggaagccggattgcaatatacctcgccggtctttgcctgtgccagccacggggacttgttcgtcacaaccttcgtgtataccatcttgctgatatgacggccgatcgtgttgtaggttaatgtcggtgaatctgcggtctgcggacggatctctccgtacggtaccagccccagcttaatcagtgcctggaaaccgttgcagataccgagcgccagtccgtcgcgctcgttcaaaagcttcatgaccgcctctgtcatcttcgcattgcggaacgcggtcgcaaagaacttcgcggagccctccggctcatctcccgcggagaatccgcccgggaacatgataatctgtgcctgatcgatcgcctttgtgaactcctcaaccgaatcgcggatgtcctctgcattcaggttcttgaatacctttacgatcgtgtccgcacctgcgcgctcaaatgctctcgcactgtcgtactcgcagttcgttcccggaaataccggtataaacacggtcggttttgccaccttgtgtttgcagacatagatactgtctgcctgatagatgccggtgtcaagttcgtccttattatctgtcacgcgggtcgggaatactttctccagcgtgccgctccatgctgcgatcgcctcgtcgagtgcaagcttcatgccgccgtagcagaagctctgttcctcatttacccagccgacaagctcctcatttccggaaagtcccgctgcctttaatgtctccttgacaataccaaccttctccactggaacctccgccacgatattaccaaatcccggtgcaaacagtgtctcttccgacacttccttctcaatcgtcacaccaagcttattgccaaatgccatcttgctgactgccgccgcaagtccttttccatccagcgcataggcggatacgaccgcaccctttccgatcagctcatgcagcaccgcatagagcttcattacctgcgcatagaccggaagatcataagaatccctctcgatggagaaaagtaccagctgatttcccactgccttaagctccggcgtgatgatgtcgccctcttttgccacatccacggcaaaggataccagtgtcggcggtacgtcgatctcgttgaagcttccggacatggaatcctttcctccgatggacggcagtccgaagccgatctgtgcattgtacgcgccaagcagagcagcaaacggctgactccagcgcttcggctcctcgctcatcctgcggaaatactcctggaaggtaaagcgcaccttgctgtaatcgccgcctgcagacacgattctcgacagagactcaagcactgcatacaccgcaccgtgatacgggctccaggaagacagatacggatcgaagccgtatgccatcatcgtgactgcatcggatttgccggtcatcaccggaatctttgccaccatggactgtgtctcggtcagctgatatttcccaccgaacggcatgtatacgcttcccgctccgatggaaccgtcgaacatctccaccagtcccttctgagaacacacattcaagtcggcaagttctgcgagccatgctttcttcatatcgcctgctgctaacgcctcggaaaccgccggtgtatcgatcttattcagataattttccttcgggtccggcatatccactgccacattggtctcctgatgtgcaccgttggtatccaggaatgcacgggataagtttacgacttcctttcctctccacgtgagtaccagtctcggctcctcggtcacaaccgcaacctcgacagcttccagattctcctccttcgcaaatgcaaggaacttctgtacatcctccggtgccactacgaccgccatacgttcctgggactctgagattgcaagttcggttccatcaagtcccgcatatttcttcggcaccttatccagctgcacgcgcagtccgtctgccagctctccgatggcaaccgatacaccgcctgcaccgaagtcattacacttcttgatgatatgcgccacttcctcgcggcggaataatctctggatcttgcgctctgtcggcgggttacccttctgcacctctgcaccgcagactgcggtggactctgtgttatgtgccttggaagaacctgtcgcaccaccgatgccgtcacgaccggtacggccgccaagcagaatgatgatgtctcccggatcggaggtcagtctctgcaccgcacgtctcggagccgcaccgagcactgcaccgatctccatacgcttcgccacataattcggatggtatacctccttgacataaccggttgccagaccgatctggttaccataagaactgtaaccgtgtgccgcctcgcgcacaagcttcttctgcggaagcttgcccgggatcgtgtctttcacggaaactgtcggatctgccgcaccggtcacacgcattgcctgatagacataggtacgtccggaaagcggatcacggatcgcaccgcccagacaggtcgcagcaccaccgaacggttcaatctctgtcgggtggttatgtgtctcgttcttaaagtttacaagccactcctcagtcactccgtccacctcgatcggaacgacaatcgagcaggcattgatctcatcggattcctcctgatccatcagcttgccctcctttttgaggcgcttcatcgccattaaggcaatgtccatcaggcacacgaatttgtctgaacgtcctgcgtaaagattcttatgggtggcgaggtaatcctgataggtctcctccatcggcgcacggtaatagccgtcgtcaaagcttacgtccttaagttctgtggaaaacgtcgtatgacggcagtgatcggaccagtaggtgtccaatacgcggatctccgtcatggacgggtcgcgcttctcctcattcttaaaataattctgaatatgtaaaaagtccttgaaagtcatcgccagaccgagggaatcataaagttccttcagttctgcctcaggcatcgcagaaaatccgtcgaaaatctttacatcctctggctccgggaacgactgcaccagcgtctgcggcttctcaagaccggtctctctggagtcaaccgggttgatgcagtgctttttgatcgcctcaaactctgcatcgctgatctctccctcgatcacataggtcacagccgtgcggatcagcggctcctcgttctcatttaacagcttcacgcactgctcggcggagtccgctctctggtcaaactgtcccggcaggaattctacggaaaaagttctcgcgccatttaactcaaaagtttcctcgtacacatcgtccaccggcggctcggaaaaaacggtaaccagagccttgcggtaggtttcctccgatacatgctccatatcgtaacggatcagctcacgcactcccttcacgtcactgataccgagataatttctgatctctgcttccagctctcttgctctgacagcaaatgccggttttttctccacatatacgcgtcttacgttgctcatattttccctccatctgcgcacgccatcggcgaaactactgatcgtttgtatttctatcttatcctactttctatatgaagtatagcatatgcgaacaaataagcataattaatatatttaatctcttctattattatggttaatatatcacataagatttatttgacagttttataagcaggtcttataattatagttaacacgctacagaacggttcggagcagcgctccgacagaaacgaggaaccatggatatcaattacgaattgtataaagttttctattatgttgcaacctccctcagcttttccgaggcgagcaagcagctctatatctcccaatccgccgtcagccagtcaatcaagacgctggagaaaaagctggagcagccgctttttatccggagtaccaaaaaagtacagctgactccggcaggaaagattctgctcaagcatattgaacctgccatgaatttaatccggcgcggtgagagccagctgttagattccggcagcctcggtctggggcagcttcacatcggcgcgagcgacaccatctgccgctattttctcgtgccgtatttaaagcagttccacaagaagttcccgaatgtcccgatcaaagtgacaaactcaacctctctcagctgcgtagagctgttggagcagggaaaagtcgatctgattgtgaccaattttcccaactctaatttaaaccagtcctacatccgcaagactgtgtgcagctttcacgacgtctttatcgccaaccctgcctattttaatctgaagcagcaggagattgccttagaggatctgcagcagtacccgatcctgatgctcgaccgcaagagcaccaccagcgaatttttgcataacctctttctgcagcaccagcttgaactgatgccgcagatcgagctgagcagcaacgatcttctgattgatctggcacgtatcggcctgggaatcgcgtttattccggactactgcctaaaccgcgagtccagagagctctttatcgtgaagatcagggaaaagctcccggcgcgccagatggtcgccgcagtcaacccgacgcttccaatcgcgcagtctacggaagaattcttaaagctcctgccgtctctcccagaactcggctaacatctgttctacttcatttacgttacatatccggcgctgttcccattcccttgggaacagccctctgtaatcactctttaaaaaccgctcgtccagcagttcaatcactcccacatcctctgtcgtccgtatcacgcgtccggccgcctgcaataccttgttcattcccggaaagcggtacgcataatcaaagcctgcccccgctctctcatcataataatgcattaaaatctcgcgttcattgctgatctgcggcagtccggttcccacgatcaccgccccgatgagctgttcttttttcagatcaatcccctctccgaaaatacctccgagcacacagaatgccaccagtgaaccgcctcgccgtttcgatgtctcaccggaaaatgcctgtaagaaagcctcgcgctccgcctcacgcatcccggtctgctgcatcatgcaccagagacgcggctctgcatttccggaattttccgcatcattgggatgctccgcaatttctgcctcttcgggatgctccgcaatctctgcctcttcgggatgctccacaatctttgcattctctgctccttccggaaaatactcctgcggacgcatttcatccgtctccccgccctctaaaaacacatcgtagacttcctgcatcatccggtaggacggaaagaacaccatatagtttccctgcttcgcgcgcgctgttttttctatatataatgcaatccgctcatactctgccctgccgcgcctcgtgtacttgctgctgacgtcatttccaaacagcagcaggcgctgttcctcggaaaacgccgtctgcgcgtagaccgcataattatccctgcgggtggacagcaagcttttataatactggatcggaagcagtgtcgccgagaaaaagatcgtcgcatttcccttgtctatgcgctcctgcagattgagggagggatccacacagtaaaacttcagcttgaagcgcccgtcctcctcatgctcggaatacacgacataatgctcgtccaccagttcgtagatattcatgaaattgcgcaggtttaagtaaaattcgttcacttccctgcgttccgggaaatcgggacttttctgcagatactcatcgagatctgccgcaaggcgcgtcagtgcaaagatcagcgtaccgatattttcatatacgacatagttttcgcactcacgcttgtacccaaggagaattcggttgcatttttccagatgccggatcacacgttccgcacgtctgtcatgcttttcctgatagggtttcagcagctttttgaccgccaagaaatcttccttatagatcgccgcgctgtacatttcccggctccgctccacaagattgtgcgcctcatccaccagaaaaatgtagtccccgcgcgttccttccgcaaaaaaacgcttcagataaacattcgggtcaaagacataattataatcccctatgatatcatccgcccaggttgccgtatccagcgacatctcaaacggacagacccggtactcccgcgcctgctctaagatcacttccctggtaaaaacatcctccttctgcaacagattgtacaccgcatcgttcacgcggtcgtagtgtcctttcgcgtagggacagtgtacaggattgcagtccatctcctcgcacaggcacagcttttccttcgccgtcagctggatgatcttcgcctgataccccctggtgcgcaaaagttcaaatgcttcctttgccaccgtgcccgtgatcgtcttcgccgtcagataaaaaatcttgtccccgagtccctcgccgaccgccttcaccgccggaaagaccgtcgaaatggtcttcccgacgcctgtgggtgcctggataaacagattcttccggcgcgcaatcgtgcggtatacgtccgacgccagttctttctgtcctttccggtatgcatagggaaactccagctttttgatggaagcctgccgcagattctgccaggcgaactgaaaatccgcccactttttatattcgtccgtcagccgggtgaaccactccgccagctccgcaaacgaaaatgtttccctaaaatatttcagattccccagaaacgccgtctttgtcagttcgattgtatccagattgcagtaggtcagctgcacggagatctctgcaagatcatgctgcaaggcatagatataggcataacacatcgcctgcgcgcgatgcacgcccacgggttcatccagcgcatccagattcatgtagatccccttgatctcatcaatcgtcacatgcatgtcttcctccaccgtaagatggttgaagttattcgaaaaatcaagctgtctctccccgtcgcacgtaatctcgattccgtccgcccgtccctcgatggcaagcgtgtaatctccctcgctaagttcgatcttaagcggcacctccgcatggtaattcgcgcctttgctcttctgaatgcgcttatggatacggctgccctcccacatggcctccggggacgcagttctcccgtggcggttatcaatgtctccctcccgcagaatgaactccaccagattccgcaccgagatctttatgattttcttttcgtctttttcctgttgtgcatccatacggcagcgctccctactttccagtttcttatcatacagtgtaacacaaaaacagggctgctgcacgaagaggtttctctccggcagcagccctgtctccgtctgtctgactagcagactgcatatttctgtaccgtattctcaaacccggtgttctgtccgccgtattttacggtcagatccttgctgagtccaagatacagcattccgagcagtgattttgcatcaatcacagctctgttataacaaacatcgatatcaaaatcacattttccggcagctctcacaaactcctttacttcctccgtgtcagacaatctgatttttctctctatcatattattcatcctttcctactataaaccaaacgtgtttctctgatttccgcgcaattattgcataaatttttttctttgtcaaatttgacgcaaccggtaaaccacttgaaagtacgggcaatctgctcatttctgtgcccgatttttgccgttttttgcaatctctttttgcgattttctctcaaaaagcaaactgcataattattcttgtgcacactttctcatttcccgcaaaggtacgtttcgtttttgtaatattttcacatattttttccccagagaaaactatttttcatctctcagtttcctaagattctgcttgagcgcctccacggcgcggtcgatctcttcccttgtcgtctctcccgacaacgtcatacgcacggtccccggtgcgtattcgtccggcacgcccaacgccccgattacataggagacccgctcctccccggtgttgcaggcggagccgcccgaggcgcagattccgtcctcatacagcagaatgagaagtgatgcaccgtccacgccggaaaagctcacattcacattccccggcaggcggttcgtgggatgtccgttcaggcggacccccttgatctcatgcatgatcttttcaatcagataattgcgcagcatcatctccctgcggattcttctgcgcatattgcagaatgccagttccaccgctttccccatcccgacgatccccggcacattctccgttcccgcgcgttttccacgctcctggctaccgccgtggataaaggaaggcatcgtaaccctgtctcttacatacaaaaatcccacgcctttcggtccgtgaaatttgtgggcgctcgcactcagcagatcgatgtgatactgctgcatcgagatcgggatctgggcatacgcctgcaccgcatccgtatgaaacagaatctgatggtctcttgcaaaccttccgatctgcatgaccggttcgatcgttccgacctcattgtttccaaacatgaccgagatcaggatcgtatcctcccggacggcatgctctaactgttccagcgagatcattccgttttgatcgacgtccagataagtcacctcgtagccctgctcctcgagataatggcaggagtttaggaccgcgtgatgttcaatcctgctggtaatgatatgacgaccgtattttccatacgcttccgccacccccttaactgcccagttatccgcctccgatccgcccgatgtaaaatagatttccgacggtctggcatccagtgatgctgcaatcacctctctcgcatgggcaatcgccgcctgcgcttcctccccgtaaccgtaagccgttgacgcattgccaaacttttccaccagataaggctgcatagcggcttcggcctcctccgccatccgcgtcgttgcagcattatccagatagaccacacctgctttatattcctgatcgcacatttttcccccacaccttacatataataaaaagattccaattcccggagacacacttgccagacattcattttcccaggaattccgtttctggaaattctctgaaaaattccctgatcaccggcacactgctgctcacactcgccggtgtgctcacacggattatcggcttcttctatagaatattcctctcaaggctgattggtgcagaaggtcttgggatctaccagctgctgtccccggtgatggcgctcggtttcgccgtcaccgccgccggaattcagactgcgatctcacgcttcgtctcctccgagcttgcgcagaacaatcccgcgggtgcgaggctctattttcggatcggcctgctgctgtcgctgtttttatctgccgcgaccggctttgtaatctggaaatacgcagactttatcggtgtttccatgctcggggatgtgcggtgcatcccgctccttaagatcatctccctctcctttgtcccttgctgtatccacgcctgcatcaacggctgctactatggacagaaaaagacgggcgtccccgctctcacacagctcacagagcagatcgcccgcgtcggcacggtctggctgctctatcagatccatatgcgggagcagaccgccgttccgctctccgtcacaatgtggggcgctgtgatgggcgaagtggcaagcacgctcgtctccgtcagcgtcgcaaaacttccgaagggaacggacacggcgctttccgtgaaatgcggcacgcgcaatctccttgccatggcggttccgctcacggcaaaccgggttgttttaacgctcttttccagttttgaaaacatcatgattcccagccgcctgcgcctgttcggttacacggcttccgaggcgcttggcgtctacggcatcttaaccggcatggcgatgtccgtcatcatgtttccgtccgtcatcaccaactccatttcggtacttcttatgcccgccatctcagaagccaaagccggcggaaacgatgcgctcatacggcgcgcggtcttaaaaaccatccgggtctgtcttctgtggggctttttttgtacagcgggttttcttgctaccggtcactttatcgggaatgtgctttttgggaacgcgctcgccggaacatttatacggacgctcggctggatctgtcctttcctgtacctcggcgtgacgctgagcagtattctgcacgggctcggctacccgggcatcactttcgtgctgaatctgattgcctgcggcatccgcatcctctttgtgctgtttgccctccccgtctacggtatccgcggctatctgtgtggacttctcatcagtcaggccgtcatggctctcctctccatcggaattctgctgcgccagacacatcccacttcccgctctgcatccgcaaaataatatgcacaaaaaataccggcaagccagattacggtttaccggtatttttattctcattaaaagtgctaaatctgatctcaaattatactctggacagatactcacctgtacgtgtgtcgatcttgatcacatcgccctgctctacgaacagaggtacatatacggtagctcctgtctcgacgattgccggcttggttgcaccagtagcggtatcacccttgaagcccggctcagtctcagtgatctgaagctctacgaacagaggcggctctactgcgaatacgcttccgttgtgagagcacatcttcaccatctcgttctccttcacgaacttcagcgcatcgccgatgtcatctttggagagtgcgatctgctcataagtctctgcatccataaagttgtataagtcaccatctgcatacagataagtgtaatcttttctgtcaatgcgggcagtcggacatttctctgtaggacggaatgtcttctcaaccacaccaccactcttaatattctttaacttagttcttacaaatgctgcaccttttcctggtttcacatgctggaattcgataatctgatagatattaccctctaactcaatggtaataccatttctgaaatcgcctgctgaaatcatgtaaatttcctccttaaaaatacgctcgagttttactctctgatttttctattttataataaacagcgctatatttcaagctttttttcatataccgcactgcgccatgcgaatttgcacgctttttgctctgttcctggcgcaatctccccggtattattaagcgttgcgcttctcaatctcatggatcatatcgattctggtctggtgtcttccgccctggaattctgcatccagatatgccttgacgatgtctttcgcaagctctgtgccgacgattctggcaccgaatgcaataatgttggcattgttgtgttcttttaccagccgcgcagttgctgtgtcggagcacactgctgcacgcacaccgttgactttattggctgcgatggagattcccacaccggttccgcagatcagtacgccgcagtcagcctcgcctgccacaactgccctgccgactttctctccgtattccggataattgcagctgtccgttccgtcggttccaaagttgataacctcatgtcccagttcctttaaatagtccataatgacaaattttaactctgttgccgcgtgatcatttccgattgctattttcattttttcctccatcccgggttttggcacccgtccttttcattgtcacatgctgccactgttttctgcagcacaaactgcttcttttatcgcttctgcgctgcgctctgctgcttttggcattttctccgatagaaaaagaggacgatcttttccagatagcgctttaagacaatctggatctcctccttcggatggatcggctttaccagaatcgtgcggattcccgtgcggttggcgccatagacatccgtaaaaatctgatctcccacaaacaatgtgtttttctcatccgttcccatctgttccatcgcttttctgtaattcgccggattcggctttcctgccttgtagatataagaaacctgcaccgcgtcattgaacattttcacgcgcggttccttattgttcgacagcagcatgcaatgatatcccagctccttcaaatgtgcaaaaagcgcgcacgcccgctcgtccgccggcgctccgtgcggcaccagcgtattatcaatatcaaaaataacgcctcgatatccatcctcataaaggtggtcaaaatcgatctcataggtagaatctacgtattctcccgggtaaaaccgttccagcattgcccttttgctcctttactcatctcacttagtgcgcatccttacatagattactacatttctaccaaaatatccacccggaatttccaattcgcgttgttcgtttttctcagagcattatttacctcaccgcgaggtgcgcatccccgcagagcgtttttgtgtaataggaacgaagtttcctattacacaaaaaagactgcatacacatgtgtatacagtcctcatccgctcatgattctatagtataaaattctcatccggtctgaccggctgtacctcgtcaggattcgttcctacaaaaaactgatactgctcgagtacctgatccttacgcatatccgaaatggcgcgctcaacatccagtctggcaatgtcgctgtccacgcccttcagctcgtagaccgcatccggctggtagctgtttgcgtaatcgatggctccctgatccggtccgctcttcctgatggctgcaggcgcagtatactcctctgtggacggcgcctgccctgttacgctctgcggaagttctgccggcagttccgatcccacggtaacagtttgattctctatggagttgtaatcataaaatcccgcactgatgcggattcctgacaaattcattagaaactctccattgtaaccagaaaaaaatattactataactttttattatatcgacaaataaaaacagaaactttaccttcttttcttatttgtcgagcatttttttcagctcgctcataaacgtgttgacgtccttgaactcacggtacaccgacgcgaaacggacataggcaaccgcctcaagatccttaagcttatccatcacaagctcgccgatcagggaactcggaatctccttttcctcgcggttaaagatctccgtctccacttcatccacaagctggttaatctgattgaccgagattggccgcttatggcaggcgcgcagcacaccaccctcgatcttggaacggtcatactgctctctggtgttgtctttcttaatcacaatcagcggaatggtctccactttctcataggtggtaaagcgctttccgcaatcatcgcaaagtctgcggcggcggatggaattgttgtcatctgccggtctggaatcgatcactcgtgtattttcactgctgcaaaatggacacttcatttgctacctccatgggcaattttgcctatatattgtagtatatctatacatttgttgcttgtcaatgaaatttacacgattatatgaccagttttttatgtattttcacgaaattgtaattttttgtacaaactttctgttttattgtcccctacgcctattttaccttatgttttgcctctttctcatcaatgtccacaagaataatgtccggtccgatttttacaatcctgcaccacggaataaacacttcaaactcccttcccatgcagcccatccactttgccggtcccggcacaatcagcgccttgatgcatccgtcgcactcgtcaaaatccagatcccgcacatttcccaggcacttacagtcatttacgttgatgacctctttcctcgccaaatcgcaaaaacgcatatactcccccgtttgcttcctcggataagtatatgcgtcttttttcataatcatgtttgtctgaaattatacattaaagcggaacaggatcacatctccgtccttcaccacataatccttgccttccattccaacaatgcctttttcacgcgctgcagcgagacttccgttgtccagaagatcctggtagttgacaacctccgccttgataaagcctctctcaaagtccgtatgaatcttgccggctgcctgcggtgccttggttcccttcttgattgtccatgcacggcactcgtcctcgcctgccgtcaaaaagctgatcagaccgagaatactgtagcttgcagccaccagcttgtccagtccgctggattccacgccgagatcgtctaagtattccttcttctcttcctccgaaagttctgccagttcctgctcgatctgcgcacagatgacgaatacctttgcgccctcttctgttgccatctctcttacttttgcgacatgtgggtttgatgcgccgtcatctgcgaggtcatcttcggcgacattcgctgcatagatcgtaggctttgccgtcaaaagattgtatcccttgaaccagatctgtgcatcctcgtcatccggcacctcaaaggatcttgccatcttgccgtcctcaagatgtgccttgaccgcctctacaagttcgagttcctttgcaagagtcttatccattctcgcctgctttgcaatctttgcgattcttctgtcaaggatctcaatatcagaaaagatcagctccaaattgatggtctcaatatctcttgccggatcgatcgatccgtctacatggatgatgttggtatcttcaaaacagcgcaccacatgaacgatcgcgtctacctctcggatatttgcaaggaactggttgccaagtccctcgcccttgcttgctcccttcacaagacctgcgatatccacaaattcgatcgttgcaggtgttaccttcttggtatgataaagctcaccgagctttacgattctctcatccggcacagaaacgataccgatattcggatcgatggttgcaaatggatagtttgcagacagcgctcctgctttggtcagtgaattaaataatgtagactttccgacatttggaagtccgacgatgcctagtttcatatatatctatctcctttatttcctttttacgggctttttgctgtataccgctttgaccgctgcgccgttctcccaaaatccgtcctgtgcttcggcgggccaacgctcctcgcagctgtcttatggcgctattctaagagccccaaattagcacgattattatacactaacaggggctcgtttgcaatgttatttcatttttcagaacgctcaggcgtatccatggaagagattcttggcataggaaccgcgcttgctccaacccagaaccggaaatatttctcactttctctttgtaaaatattatactgtatcttacaatccccggatgatgttcaaataatccggtctatggtctacgacagcataaataatagcttcctgcttctcctcatttatcttgtaaaacacaagatttttctcaagtaccagtactttatacccctgtcttttaagcaccagataacgaagttctacacatttttgcggatacttgcctaagtcaagaagattccgttctaattcttcaagtttttcaagtgcaacttcccttccaaagttttctgctacatacaaaataatctttcggatctgagcatctgcagtttctgtctggacaactttataattcaatattctatccctcccgcagcatctgcctcaaatcctcaaaggtctcaccgagtggcgctactcttgcgttcctcacatcatcttcttccgtattgtctccataaaatcacctttctcgaatacatcgaatatacctcacctgaaatccatctgatacgatgaccttcagatacaaagaaagaccgctcactttcaatttttcttgaaaatgaacggtctttcatgcctctgttatttagttgaatgatgatgatattattttctctttgatacgtttccgaagccgcagtccaatacgactgagacattcacaccatctgaaattacttttttgtatgtttttcggtcactctggtcaaacctgaaaaacctctcaaagtgtcggaagtcgagaagttttacaaatctgtccgatgtagtacaactatcgtctccacatgaaaggactgctgtctatgaattaccatcgtgaaaagaaacatatccatgaaccttttaacaataggtcgaggctatcgttaaaaagtgtcaccactgaaaacaattttttaactgttctctacttttgaattgcttctataatatatgtctttccttggaaaggaacctcatctccaatccagcagcaagcaatttttgtttctgtgcaagcagctctgtatttcctggatcaagttttaataacttgtccacgtccttcaactgctgctgtgtactttttatctgaccgtttacgcactttaatgttgcttgtagtttggcggtatctccgccgatctcgacagtaatacccataattctgttagccacggccgatacctccttccgtaaaaatgggcataaaaaagcacagatttctccattcacgaaaaaagcaccaaccatttctgattgatgctttcaaattattttgtttttgtaaatctgtttaattgcgtatccacatctcgtccaccgtacataacacggataatcgtaaccacttgtgtatcatcatccggaatatatagaataagataattgtctactggcgctacgcgtagccctcgacttttccatggttccaattcatattgtcgatatctcttcggcatatgatcaagatccataatacatgcttcaagcctatcaagctgaccacttgcattttctggtgcctgcagttcaaaagcaatgtattccaagattccacgaaggtctatctcggcctgatctgaaatcacgatatcataaatcataaattgtaatccttgcggagatcagcaaaaacagattttgctgatctagtgcgaccagcctgcatatccgcatatcctttctctagttctgcattcatctgtgcttctgataatgcactaacgtctacaggacgagcggatggcattttcacttcaaaaggaagtcctctttgaagaataatttgtttgtaaaacatatttattgcattggatgcaggaattcctaatgctgctaagattccttctgcctgttcttttacatcaggctcaatgcgtgcgtatacatttgctgatttcgttgccatagtaaacactcctttcgagtttttctaactatattatatctatttgtacggacaaaagcaatacaaaatcaatattttacaaattgtttatactccaaaatctaccagttgattaaaatttgtcgaagtcctcctgagtcgccacttccttatatcctttataatcatcgtcactgttttcagcatacatatcattcacgaggccaatggtaagcaaatccaggtctcggatactaatccccagttgtacgcaacgaagcaaaaataaaggtgttgtcatcgggcgatctgttggacgaacttttacggattggaatgtgagggaaattctcgtgtattgtgttaagcacatccctatatcctgcaatctcacgctcatttcttgtctttggcattgtcttatccaaaacattctttttcaaacattcatcagaagtatagataccctcaattttattagaactctctgtactttgaatcttagccacctcaacaagactttctaatacatccgcatggtgttccgcaattaagcgctgttcccccttgtattcatgaattgttgtaaggtaacgcacgatttctggcgtaagcatttttttccattttttcgtgtaatcaaattgtctcattctaattacctcattttgaactcaacttcgtcatttcattcattatgacgcaagtcgccgccacccttaaaaagggtggctcgagacgctgggtgtaaccccttggtacccgacagcgtctcaaggcgccctagactttctcttcgttcaagtcactattgcacttgacgcgttgcttatgcccatgaatgggcgtttgtactacttcgacttaacccttaaaagggtcttcgtactccttcacacttaatttatcttgcatgatatcgtacttttcttgatcttgaatgtatttttttattgtcgcttcatttaatcctacggtgctgacataatatccctctgaccaaaaatgtctgtttccaaatttatatttgagatttgcatgtctgtcaaaaatcataagcgatgactttccctttaaatatcccataaaactcgacacactcatctttggcggaatacttactagcatatgaatatggtcaggcatgagatgcccttcaataatctccacgcccttatatgcacataactgtttcagaatatcacgtatatcctcttttaattgattataaataatttttcgtctatacttaggagtaaatacaatatggtatttacacatccattttgtatgggcgagatcattagacttattcgccataaaacacctttcctttcttgcaatagtgactgaacaactctattgtaacggaaaggtgtttttctgtataacgatttgactccacccgcatagcaggtggatttttgtttcgtgcatctccatttctcttttgagaaattccgatgtactcaactggctaaagccataattgaaaaaggaccagcccaagctgatcctaatcctctatcacatcctcgattctattgtctctcaaataagaagaaaaagccaagcctcatgctctgcttaatctccaatgcatttcattacaaaaatgacatcatcgtatagcaaatacataaataccccggcaccgcatgctatatgtgtaccacatccgaggcaaaccatacccttacacctcaatctcacgcccgtgaatatcggtcatacacagccggtttctcccccgcctcttcacacggtagagcgcctgatccgccacgtggagaaaatcccagttcttgttcccgttgctcgggatgtcatggcagatgccctgcgagatggtcacaccgaacgatccttccgcatagcggcgttctatatgcagtgccatcacatcctgccgcagcttctccgcgcgctcacagacttcctccgcgctcattccactgtaaataatgacgaattcatctccgccgtagcgcgcacagaaaatctgatcactttccatctgccggatcagtgccgcgatggcacgcacacagtcatcccccgcctgatgtccgtaacggtcgttgtactgcttaaaataatcaatatccaaaatctcaaacgacaacggtttatgttccgcaaagcactgttccacgatcttttctgaatcatttgtcagacggtaccggttcgccagtccagtcagcggatctctctccgacttttccgtcagctccaccgcatcctcctccagcttcctgcagcgctctcttgcccgctctaaggatttgcgcagataaagcatattgacaatcatgcttctgttttcctgttccacgatctcggtcagttcatagaatctgccagccgtcttaagatagcgttccctgtccttcgttttcttaacataatccatctctagcgctgtcatcttccgctgcatattggcgatgccggtctgctccacgaatgccttcagtttttctccgatattgcggcagacatcaccgcggtcaatctctaacatcagttcacagaaatcatacagatcatcaaacaaatccagaatcagtacatcaccggaaagctgattctgaatatccgcaatatactggtctctcatggaaatattgccacacagatgacagtaacgtgcacgcatacagtttacataaatgtaatccatctcctcaaaatgcgcttcgcactctgtctccagtttgcggatatattcctctgccttctccaggctgccgcttttcatataacacagggccagattgttgtaaatcgcggtaaggcttgccaggctgcgctcctcttccggtacgcgcttgtaatcgagatgcgcctgctccagataatctctggcatcactgtactgtccgcactccatatacagggaacccaggttactctcaatccggctttccacctcaattagctgatattttttgcaatattttaatcctgccagataatactcgatcgcaaacgacagattgcccttgccgacggatacaatcgccataagattgtaggaggctgccaccagttcccactgcccggactgttccagatatccgagtgcctcgccgatctcctcaaacacctttccggtctcattgctaagatagtaggttctgcccttgtaataatgcgaaaatccaagcagcctggcatcccccgcacgttctgcatattcctcaatctgcgtgcagtagtcaagcatgctcgccgcatccgtgccgcgaccctctctcactttctgcatcagatcttccatccggtcatcggtcttatgattttccatagcacgactccttcaccttttatctgttcgttcgcgctgcaatattttcttaacttctacacaaatacatacttccggagacgatccatcgcttcctccacgagagaaaacggcaatgcgagattcatacggatgccgcacgggctgtggaacggtcttccatcctgccagatcactccgacaccgacaccccgcttctgcagttcatcgatcgttatgccgtgctttctgcaccactctgtacagtctaagagcagcatgtaggttccctgtggcatagctacctgtacgcccttaaaatgggatctgatataatcatacgcatattctgcattcttcgtcaataccttacataattcatctgtccactcatagccttcttgctgatacgcaccaatgagtgcatacatggaaagcacgttcatttcattgtaatgtgacagcgatgattcctttttcacgcggtcacggataacgggattgtaaataatatgataacttcccaccagacccgcaagattaaaggtttttgacggtgcgtacattgccaccgtgtgcattctggcatactcagaaacactctgcgtcggcacgaattggtgatccccgaggatgatatccgaccagatctcatccgcaaccacctcaacctgatatttctcatagatctccatggcacgctcgatctcccagcgctcccacaccctgccgcacggattgtgcggggaacagaaaatcgccgcatgaatgtggttctcgcggatttttttctccatgtcttcataatccatacgccacacgccattctcatccagcacaagcggactgtgcacgatctcatacccgttgtttttcaggctgaaggtaaatccgatgtaggtcggcgaatgcacgagcactttatctccccgcgaacagaacacattgagtgcgcttaagacaccgccgagcaccccgttctcatagccgatgcattctctcgtcagcccctgtacgccattccttttcgcatgccagcggattattgcatcgaaatattcctctcttggctcaaaatacccaaatgccggatgtgcgatacgatctgtcatcgccttctgtaccgacggcaccgtggcaaaattcatatctgccacccacatcgggatggtagaaaacccctcctgcaccgttacatctttacagggaatcttatctactgccagtgcgtcttttccttttcgatccataatcgttgtaaaatcaaatttcatccttttttcctctttcttctcactgccatggtcgccgcaaagagcaccacggctgccgccgatattacggctcccgtcagaaatccggggcttttgtaccgcagttcaaactcatgtgtgccttccgtcagataggtgctgataaaagcgccgccaaacgtctcactgtccgttttctttccgtccacatacagcgtccagccatcctcatccgcgatggaaaaaatcagtctgcccgcctgtgtgacgtccacgtttccctttaccctggtatcggaaacttccgtcacttccaccgcctgtgcggcaaacgcctcataggccgtacgaagcgccatgagatccagccggtaaaccacaagctgcaccagctcattggcggtgttggtaacttttacctcttctcccgcctcacaatatcccaaatccagaatatatccgtgggaaacttttgtaaagcctctggttcttcccgagcttacctgctcctgcagattgtcaacgcccgtcttgctgtaggtggcataataatatgcggaatcctgcgcgacaaaagagctctctcccgcctttgattcggattccaccgcggtaagaagcagtctgtcgcttcccagaagattggcgagctgattctgtgtgccgatgtcgcctccgccggcatagtcccatttttccgccacatcttcatccatcatgaatcccagcggcagcacatacgcgttctcatacagatacgtgtctccacgctgcgccacaagtgtgcggagcggtccttcctccatcgcattgtccgcaagcacatagcggatggaaagcattgccgaaagaagcggtgtcgcaccgccggcacaataaaagttcttgccgccctccattccgacatcctgataaaaatggctgacattcagattcatcagggatgagaactgtgtaccggagtgatagccggacagcgccgcatcatttttggtcttgcgctccagttcctccgtccggtaaaacacggaatcttcatcacttttttccgccgtctccgaaagaaccgcccggtaatccgccagatttttcacataatccgtcctgcttatcgtgtcaagccctgtcaggttatagttgatcacaagctccgccacaaccgcaagacacccggtcgccagcatcagctgccggattctcttttttcctatgagtatgccgagtacaatcacaaaatagcaggcaaagaatgccccgcttgcccatatggaggtctgctccatcgtcgtttcgtccataaaatgattgcagaaaagcaggaatacaacgctcattccacccgctgcaaacacctgccacagctttaattcacggatgtaaagcagcgcctcataggcaatcacaagtaccagaaacgcgtacaaaaaagactgtcttcccggaagcgatgtcgggaaatgaaggccatgccagataaaatccagcatattatttgaaaagctaagccagaaaaacacgacgagtgccagccttggcagttttttcttccatggaaccgctctgttccacacatacagaaacagcagaaagagcgcaaaaattccgcagtacagattgggccagtgggaatctcccgtgtatacatcgactgccagaagggaccgcgccagctccgatacgatattaaaataccactccatcgtctccgggaacgatattccggatgcaccgcttaaggagagcacctttgccgtcggaaggatcagcactgcgcctgtggctcccgcaagcagcgaataccacgcaaagcggatccatgcccggtaccccgatgcccggtgttccatccagtagagcaaaaaccacaacaccagaaaaatgcagatcatgatcgaaatatagtaattgctcagaatgcagaccgccagcgacacataataaagccctggtctgttatcacggatcagccgctctaatcccagaatcacaagcggcgcaagcaccatgcagtccgtccacatcagattccaggcatatgccgccataaacgcgcacagcgcatacgccgcgccgcatacagccgccgcataggatgccacatctgccggaagccgcactgccgtcttcttctctgtccgtatgactgccgccgcatttccggcatcctgccacacaagaaaatgctctcccagataataggtaaacgtaagaccgctcagtgcaatcttaaggatggacagagccgtcataaattcaatcacatatcccctcggccacagaatcaaaagccagtttaacgggctggcaaggtagtacgcatacagggatacaaaatccgctcccagcccgatgttccacgaatagaacggactgcctcccgttttgagtttttccatcagctctgtaaaaaacggacaatactgatggtacatatcaatatgaagcatacactgatccccgaacggatagatttcccggttcacacagatgatcagcgtgatcagaagcggtatgcaaaacgctgccagtaacggtcctctctttttcattctccagactcctcttcccagtcaaacatgaaataatactgaagtttgcggtaaatatccatctcgccgtgctcctccttcgccggagtctcacttccgtccgcttccacggtacgcaccgccgatatcaccggatacgattcctttaatgtcagcagaaaattctgataggcatccgtgggtaccccggcgcgctttagcacctctgctcccagataatttgcgctggtatccgcattctgttcctcatcaatatcgtaattcgcccagatgacatacggcacctggtaacgcagcttttgctgttcctcatccagcgcattccactgcatgccgttcatggcgaggatcggcgccgccaccgtatcgctcggctgatgatccccgaaaaagacgatgaccgtctgctcatccacaccggagaaataatcgatcagctgctctaatgcctgatccgacagctttatcaacgaaaaatactggctgaccgatatgctgttcactccgtccaccgaaatacccggcgagaagttcgtgtaggtctggtcgtatcccccgtggttctgcatcgtcacattaaagacaaacagcggtctgccctcctccttctgctcatacagctggatgattttgtccgcacaacttgcatcgctcacataatctctgacaaaacgtgccccgtaatactgatctttaaaaatgctctgctcaaatcccagccatggatagaccttgtcacggttccagccggtggcataatacggatgggtcgccaccgtctcatacccgagcgactgcagataggatgctaacgacgggcgttctccgctcacatactgctgatacgggatgcttccctgcggcaggaacgccatcgtattcccggtcaggaactcatactccgtatctgcggtatttccaccgcacaccgagacattcaacatgccggtcacggtattttccgccccctgctgcaggctgtgcagaaacggcatatagtcctcattggtcttaaaatctcctaacacggacagatccgaaaacgactcattcatcacgacaatgatattcggcatcccggtatctgcaccgctctgcgaagtgtcatccgaggcatcttttccctcttcctccaggattgcatcgatcgactcctccgtctcctgcggttcctcgtatttttttaaaaattcctttgcctcgcctacactgtatttctgcggtttctcaatcgacatatacgcaaggttcatcacaaaagtaaccggtattccgtccacctgtgtcataaagacgggtgtaaacagcttattgtaaagcctgtgctcgttctggaaattctcctgctgcaaggttcccgcaaacatcacaagcaccgcgccaagcaccacgcccggcaggcaccgcttaaaaaatccgggtctgccaattttaaacttcaccggctgcaatccaatgatcagcgccagaaacagaattgtcacaacgatcatacgcgtatccggtgtaaagtcataattgccggacacacttaccgccgtcctccaggacagaatgtcccacggtaccagcgggttggtgcggaaacgcaccacataggcattggcaagcccgaataccagcgccgcggtaccctcgatccgatatgctgcccggagccgtccggtaatgcacaaaaaaatcccggcgagcagttcaaacaatacaatgttaaaaagctgcgcccatggccgtacctccgcaaacggattgtgtgtgtaaaattccagcaaataaaaaaatgcggcgggaggaatcaatgccacagttccccacatcacatactttgtatattttgataaagtttttttctgactcattttgactgcctcatattattttggttcttattttagcacactgcatttgtttttcctatttaattcgcaaaaaattcacaaaagcatttccgtatgttcttccagttttccacatactttgtcgaatatggctcattttttgacacatcttgttaatagaccgctttgattcgcacaattcaaacaactttcattgacatccggaagttcttcgactatgcttacacttgtatgataaattcatggaaaaggtggctgttatgaacgagaatctcgaattggaccgcttagcaaaagaaaacgataatttcaaaaaaattattcagacacagcagaataccatcaaccgcatgattgattattttattctgggcgagaaaaaacctggattgcaaaagtagctttcttcgtgtgacagtgttataataagcacacagaaaactatcttttacaacacatgatttcacggaggataaaaccatgttccaatttacagatgactgcctgatcgggatcaaggagctggacgacgagcaccgccgtctgttctcattgatcaatcaggctatggatgtactcaaccataccgattccaacgaccgctgcacccagatcacccatctgctggaggagctgacgcggtatgccgatacccattttgcacatgaggaggcttacatggagcagatccgcgatccggagctgatccgtcagcgcatgcagcactctcttttccgcgacaaaatccgcgatttttcctttgcagacatcgatgaccccggaaagcagcagcaggttgtcaccgatcttttgaatttccttgccaaatggctgtatcaccatattctcggaagcgacatcatgatcggcaagctgccgccgttagaggaatggatgatccgcgacaacccgtgtgaattcacagacgattatctgaccggcattgaaatagttgatttggagcatcagcagctcttttgcatcgtggagcgcgcctatcagctggtaaaatccaacgacgtcattacgtgctacgatgagcttttatctatcattcacgaactcacggaatataccgtaacccactttgccgacgaagaggcttacatggagaagatcggttatgaggggcttgccgcacagaaaaatgcgcacgcttccttcgtcgccagacttgagagcatcaacctgatcgagctggacgaaaatccgcaaaaatatatggagagcctgatcgaatttctgcttggatggctgatcaaccatatcctctattccgacaaaaagattcctgtccaggcataaccgctgcggacaggcacagacaatataccgtacacatttatgccgtacgcatttcaagttcttaaacatgcgctgcggatccagcatacaaaaggagctgtgaatgatattcacagctccttttgtatgctcttttcaatataatgccggcggccggacttgaaccggcacgaggttgcccccgtcagattttgagtctgatgcgtctgccattccgccacgccggcagtcttgcgatcggatctctccgtctcgctcacgcacgatttatcatatcataccctccttcatattgcaaccacatttttcacttttcacacctcactcctcttcctgatttcattgacaaaagttatcatatatgataactttatagcagacgattttttacggaacacctgtatttttcaggagaattgagggattcatgaaggaacaaagcccgcttaccccgcgctatgaggtcgtggaacagctaaagagcgcgcgcaaggcgcagaatgtgacgcaggaggtgctcgcagagcgcgtaggcaccaagaaatccaatatatcccgttttgagagcggccgttacaatcccagccttgattttctgattaaggttgccgacagtcttgggaagcagattcagatcaggattcgttaagcatgaaggaggagtttttatgacaaaaggaaagattttaggtgatattcaccagattgacaaagacgtggagctgtgccgcaccaccaatgaacgcatcagcaatcaggcggcacagcttctgattgagaaccagatcccctttacccggggctggatcaaggttccgttttttcttcgggaaaaataccgcggtgcacatcagatctatgtgatccgtacaaaccgcaaccgctacgggcaggcaagacgcaccatcgaccagctggacacttctttccggcgcagactgatcttaagcaactactgatccgtacgcacgccatcttcctgcactgtttgcgccatcagtttctcaaacagtgccaggaactttttttccacttcccgcatcggacactcccggtattccggcagcaccgccgcctgcggcgccacatcgaataatttttctcccgtgaaatgttcaaattcataatacaggcaggtatcatccatgcgctttacaatctcgcgctcccgctccgtcggcggcgcaatcaggtatttttcatagatcatctcctgaagcacctgctcaatcctgcggtattcgggcagacagcccttcaccggtctggtgatatccgacagatatgcctcgctcgcatcgtgcagcagacacgccagaacctccctgctgctgcgcccttcggcctgcgccattgcagcacagtccaggctatgctgcgcaacagaataaaataccggaaaatgcccgttggcacgtgtcattaacgacagcgcatgtgcaatatcctcgatacagatttcttccggtctaggatctgccggtgatatatgtatcccggaaaatgtgcaaatcttctctctcatcccgtttcctccatgctcttcttcaaaagacgatacaacgcggcggtatccaccggctttgcaatatgtccgttcattcccgcattcaacgccgcactgatgtcctcggtgtatgcatttgcagtcattgcatagatcggtatctccccggcatccgggcggctgctcttctgtgcgcggatcgctttcgccgcttcatagccattcattcccggcatctggacatccatcaggactgccatataggttcccggtgctgattccatataccgctccactgcttcctcaccgttccacgcatgatccacatgcatgttcacaagctccagcagctccgtgacaatctccgcgttcatctcggtatcttccgcaagaagaatccgtctgccgccaaaatcataagactctgacgcatcttcttctgcttcaccttcccccgtctcttctgctttttgctttttctcatccactgcgtgtgccagcggcagggatactgtaaaggttgttccgacacccttcttcgactggcaggagatcgatccacccatcagttccaccagattcttggcgatagaaagtccgagtccgcttccgccgtgatgctgtgccgtctcggcctcctcctgctcaaacggcaggaacagccgctcctgcatttcctcgctcattccctcgccggtatccgtcaccacaaatttatagaagaactgttcctgctgcattggcagttcgctgaccgtcacgcggatactcccgccctctggcgtaaacttataggcgttggaaatcagattcagcaatacctgattgaggcgcagcacatcgccttggacctgttccacctgtacctcgtccatctccacggtaaaggcaatctttttctgctcacactgcgttccatatactgctgaaattgaatccaacacctcttttaaggaaaacggtgcctgcgcaattttaatcttgttgctctcgatcgcagacatatcaagtacgtcatttacaatcgcaagcagcactttggatgaggtatcgatcttatccagacactcttctacccctcccccttcatcgctgcggtgtcttgcgatctcagtcagccccacaatggcattgatcggcgtacgaatctcatggctcatccgcgcaaggaactgtccctttgcctcattggcactgttggcctgtgccaccgccacagcgagctgctcgtttttctcttccagcttgtggtaatttctgcgtctcaaaagttcaaatgcaaccatccatgcgacaatctgcagcagaaggatgccgatcacggctatcggataacggaacttgtacaccatatcggagagtgtcggctcataggcggttgccagcgtgtgatccaccttaaactgggcaatctctttttctgatatcatcccaatgcacttgttcaaaatctttatcagcatgcggtgttcctcgctgtccaacccgacgattcccgtattttcctccataaaaaaagtcggaacagcagcaagttcctcataatagggatttgccagatacggcgtcagcacgctgacattctgcgccgcaaaatctgcttttccgtccaaaaccatggccagacagtcttctaagttcttctcctcacagatctcaaactgcggggcattgagctggatataatgttccagcccgacatagcttgccggaattgccagacggtatgaaacatcgtccgcatccacatcatattcctgtccgtttcttccgaccagtgcgacgtcatccgtataaaagctgtccgtcagaatatagggctccttctggaaatcaggattgtccgagagcacccctgcaaccagactgtccggatacttggacagatagtccgccgtgcgcattccctgcggcatcatcacatactgaaatgtcagaccgctgcgctctgacagcagatccagaatgtcaactgtaataccgtcgacatttccttccgcgttccagtaggacaacggtgctcttgaagcaataaacgccaccgtaatcacgcctgacccttgaatgtattctgcttcctctctggtaaagacgacctctccctccgcctccttctccccgtaatatttctgatagagatccgcctgaaacgaagctccagcctcggcaatctgcccgagcgcctcgtttacctcggcaagcagttccttgttctgcctcccagtcataatatagaacggatcggaaccgaagcggcagatgatcttgtaatccgtcttgagtgcaagacttcccatggcaaccgcgtcaatctcgccgcgatcgagcgcaccaaaacatgcctcctgcgtgtcatagatgctctcctcgtaggaaaatcccttttcggcggcatagtccctgaattcctgattctggaagctgtccttcagcattcccacgcgcatgccgttataggcggcatagtcattgtagtagtaaatatcgttctctttactcacgtacagaacactcgtctccgccccgatagcatagtccgaaaaaagatactgcttctcccgctcttttgttctctgcgcctggcagatcatatcgatctcaccggtctcaagtttttttaactgctgatcccagctgtcatactcgaattcatactcccagccggtatattctgcaattttgtgcaggtattccacaccgtagcccgtgtaggttccgtccttttcttcagtgataaatccgtcgtaatcgatatacccgactttgattacatgccttttctcctgatccgccactgccgccgtcacgctcaaggtactgcacagcacacagcaaacaaagcagatcagcgccgccacgcgtctgtatcttccggtcactcttgttcctccctcataccatgcagccgctccacaaaggataccgcaaatttctgcacatccacgcctaccgcttcctcaaagctctctcccgtaacgatcgagttggagataatgcggattcccagaaacggtatgccatacgccaggcaaagctctgccggagctgcggattccatatcttctaccgcagtcttataccgctctcttagcagtgcgatccggtccagctggttgttccactcatccgccgagccgatcactcctctgcccacataaacatccgtctgtaccttcatcgccgcatccccaagcctctcatcacacgggaaatcgagtactttccttgtctgtccaagtgttttatcgaaaatttcaatcggcagcggctcaaaatcacactcatcgattccggctccctcgggcgcgtatttccggatcatggctcccatcggaaccacgcgctcccccaccacgatgtctccccgatggaatcgcgcatcatgacctccgccaatccccaggttaatcaccgcccacaggcagaactgtgtcatggcaatggcggttgccgccgccgcattcaccatcccctgataggtgcgcgagataacgaccggctccgcgtgcttccccaagaatcccgtatagaatttccagttgccgcaggttatctcctccggttcgtcaagctgtccgatcagatactccgtctccgtgtccatcgctccctgaatcagaagcaccggctgttttttgaaatcgtaatttggcatgttttcctcatttctgtcttttcttctagcacattctcatttctgttgtatctactatacgttgttaaacttcccgatgtcaagggacgtatttttttcttgacggataccgctttctgttttaaggttttagtataatcagacaggaggatttttatatggaaaaaattgccagctttaccatagaccacatcaaattacagccgggtgtctatgtgtccagaaaggatcatgtcggagcggaagtcatcactaccttcgatcttcgcatgacctcaccgaacgacgaaccggtcatgaacacggcagaagtgcacacgatcgagcatctgggtgctaccttcctgcggaatcacaaggacttctccgataagaccgtctactttggaccaatgggatgccgcaccggcttctatcttctccttgccggggattacgagtcgaaggacatcgttccgttaatgattgaaatgtttgaatttatccgggattttcggggcgatgtacctggtgccgcaccaaaggactgcggaaactatctggatatgaatcttggcatggcgaattatcttgcgaatcgttatctggagaatactctgtatcacattgatgcagcgcatctcatctatccggaataaaatcttatcaaagaaaaagggtgtaacgtctcaatctctcaataaagactttacaccctttgttttttataatttgatttaaatatcgtccagggattctttgatcttatccatgaatcccttctttttcttaggcttctcctgcttatcggaagaacctgccccgtcctgggcgccggttcggtttaaggaatcacccgtcagcgcatcaaactgacgtaacgcctcctttgcgtctgcggaaagcccggtcggtgtctgtaccaccagatccacatagtgatcgccgcgaaccgatttgttgcggagcgacggcacaccttttcctttcagacgaattcttgtgttcgtctgtgttccaggcttcacttcatacaacacatctccgtccaccgtatgaatacggatctctccgccaagtgctgcctgggcaaaggaaatctgtgcggtggaataaatattcatatcctgccgctgcagggtcggatgtctcgatacgacaacctctacgagcagatcgcctctcggtccgccgttgattcccggctcgcccttctcccggatacggacgctctgtccgttgtcgatacctgccggaatcgacacctgaatctttttcttgcttgcaatgtatccggtaccccggcaatccgggcacttgtctttgatgatctttccggaaccgccacagtccggacaggtctgcacattctgcaccgtgccaaagaaagactgctgtgtaaatacaacctttcccttaccgccacacttcggacaggtctccggcgttgtccccggctttgcacctgttccatggcaggtatggcactcatcctttaacaccatctcaatctctttctcacatccgaagattgcctcctcaaatgtgatgcggacactggttcttaagttggagcccttcataggaccatcatttgttcttcttctggaaccaccgccaaagaaatctccaaaaatgtctccaaaaatgtctcccatatccatgccggagaaatcgaatccgcccgctccgccaccggtgccgtcaaacgctgcatgaccaaactgatcgtactgctttctcttctctgcatcggaaagcactgcataggcttcctgtgcttccttgaacttttcttcacactctttatccccagggtgcatgtcgggatgatactttttggcaagagtacggaatgctttcttgatctcatcgtccgatgcggtcttgcttacacccaagacctcataataatctctcttatccgccataacttttcctctattcctctctactgcacacggggtttccagatgtcaccatccagaaaccccatgttttatacactgcgttgaaatatcgtaacacactctggcttctttgtaaatgccgcagcttctgtcagattatacttccttgaagtccgcatctacaacatcgtcgtttgcagcgcctgtgcttcctgtgcttcctgcaccgcccatattgctcatatcaggacctgcgcctgctgcaccctgtgctgcctgtgtctgctcatacatctttgcaaataccttctgtgcactctgtgtcagcttctcctgcaaggattttaactctgtcacatccgcctctgtcatctcttctgcattctgatgtgcatccaggaatgacttcactgcattcatgtcgttctctacttccgacttatcggctgcatccaggtttgcgccaacctgatccagtgcctgctgtgtctggaatacgaaggaatctgcatcatttcttgcatcgattgcttcttttctcttcttatcctgtgcctcgtactcagctgcctctctgactgccttatcgatctcatcatcagacatattagaaccagctgtgattgtaatatgctgctctttgcctgttcccagatcctttgcggatacgtttacaataccgtttgcatcgatatcgaatgtaacctcgatctgcggtacaccacgacgtgctggcgggataccatccagacggaactggccaagggacttgttatctcttgcaaactgtctctcaccctgtacaacgttgatgtctacagcggtctggttgtctgctgcggtggagaagatctggctcttcttggtcgggatagtcgtatttctctcgatcagtcttgttgcaataccacccatggtctcgatggacagtgacagcggtgttacatccagaagtaagatctcacccgcaccggcatcacctgcaagcttaccaccctgaatggaagcaccgatggctacacactcatccgggtttaaggatttgctcggctctttgcctgtgagctgtcttaccttatcctgtacagccgggatacgtgtcgatccacctactaacaatacctgacccagatcagcgttggtcagtccggcatctctcattgcattctgaaccgggattgcggtcttctctaccagatcatgtgtcagttcgtcgaactttgctctggtcaggttcatatcaaaatgcttcggtccctcagcagttgctgtgatgaacggaaggttgatgttggttgtggttgcggaagaaagctctttctttgccttctcagctgcttcctttaatctctgaagtgccatcttatctgtggataagtctacgccctctgccttcttgaactcatcgatcatccactgtgtcactctgttatcgaagtcatcaccgccaaggtgtgtatcaccgtttgtagaaagtacctcgatgacaccatcaccgatctcgataatagatacatcgaatgtaccaccgccgagatcgtataccatgatcttctgctctttctcattgtcaagaccgtaagcaagtgctgctgctgtcggctcgttgatgatacgctttacatccagtcctgcgatcttacctgcatccttggttgcctgacgctgtgcgtcgttgaagtaagccggaaccgtgatgactgcttctgttactttctctccgaggtatccttccgcatctgcctttaacttctgcagaatcattgcggaaatctgctgcggagaatactgtttgtcatcgattgctaccttgtaatcggttcccatatgtctcttaatggaagagattgtcttctctgcgttggtgactgcctgacgctttgctggctcaccgacgagtctctcaccggtcttcgtaaatgctacgatagacggtgttgttcttgcgccttcctggttggcgataacggtaggttttccaccttccatcactgctacacagctgtttgttgttcctaaatcaattccgataatttttcccatgatagattcctcctcatcatattctaaaaacaaatttgttacttttgctgcatttatattaacgcggacatcttacgatgccggcacgtctgactgataaaacggctgctatgataccactgcaaccatgctgtggcgcacaacagaatccttatacatataacccttctgtaactcctgtgcgaccactccggaatcgtactcctcgctttccacctgcatcactgcattgtggaagttcggatcaaattcctgaccgactgcctcgatcggctttactccgcttgcatcaagctcggtaagcatctgtctgtatactttatccatcccgacgacaaacgcatcttctcgctgctcctccggtactgctgccagtcctctctcaaaattgtcaatcaccggaaggatcttctcaatgatactttttgctcccatatcgtacatctgtgttttttctttctctgtgcgcttacggaagttgtcgaattctgccatctgacgttttaatttatcattcagttcctcgatctgttcgtcttttttatctttctttttcttaaagaatcccttcttctcatcggcaggtgcttcctgtccgtcctctgcctcagattcctctgtctcttctgcctgctcgccggattcagctgtttctgtttcagcctctgtctcctccgcctcgcttacctcttctgcctgcttctctgcggcatctttttcaagatcctctaatacttcttccatcatttcttcttttttctctgccattccaatcctccatctatgtctcaccttttggtctgtccaaaattccatcgagagaattcttcaataccttcaggttatccatgactttctcataatccattcgcttcggtcctacaataccgatggttccgcgaatcccttctcccaattcataggttgctgtaaccacgctgcagtccttcatcgtctgaatcgggctttcatttcctatataaacctgaatccctgtgctcttatcttccaacaggttctcagtgacaagtgatgcaagctgctgcttctcctcaaatgtggagatcagttcactcgctttttctgtggaatcacttaactccgggtatttgaacaggttcgttgtcccgctcgtatagatccggatatcctcatcctgtcccatcgtctctgccacggtatccagcacatcactgatgatgtcgctgtggattcccgcctgctccttcaacttggcgatcgtgccgagattgatatcctgcaaggcaagaccgttgagattcgagttcagcagaatatttaacttcagcatcgtctcattgtcgatcggctcggatactggaataatcttgttcttgaccagattaccctccgtgacaatcactgccagtatctgttcttcattcacattggaaagctgtatgaactttaccttgttgcggtggtagctcggtgccgacaccatcgtcgcatagttggtatttgccgccagcatctttgccacctgctgaagaacctgatctactttttccgtgtgttcaatgacgaacttcttcatgtcatctacctcacggttcttctcttccatcaggtgatctacataaaaccgataccccttatcggaaggaatacgtcctgcggaagtatgcggctgcaggatataacccagttcctccaggtctgccatctcattgcggatggtcgcagaactcagattcagatctgtatattttgaaatggttctcgacccaaccggctcgcctgtctccagataattgcggatgatcgcatctaaaatttttactttacgttcatctaattccatctcgtccatcgctggtctcctgctgcttttcctgcagttccttttgtcttattagcactcgttgctatggagtgctaacaccttacgtacttaagatagcaccaacctatttctttgtcaacaggatttttcataaaagttgtgttttatttgtgattttatagtttgtttataaatagaaaaaatcctccgaaggttccatgtcctccggaggattcccgcatcactttcttctattataatagaatacacatttctctccatctatatccgcccgtcaggcggaaaacttccgctaaaacggtcggaaacagcaacagttgcagaggagatccagacagagcaggcttaagcaccagttccctgcgctcgcatacggtctgtcgtagtcacttcccatgctggtataccatgtgccgccatactgaagatgctgtaaaaactgccggtattccatattgctcggctccatctccaccgcacgctttgcgtgttccatcgcgttgatgttattgcccatgccctgattggcaatcgcgctgaaatagtaccagcgcgcccggcgttccccaaacggaattccgttcagcacattcaacgcctccacatagtgtctgcttgcaatataatttgcagccgcctgcatcttcggcgattcattctgaccgaatccatggctgccggcgtaactgtaaccgccggaattgctgctgtagccgccgccataaccgtatccaccgccctgctgcttctccttcatgatctggtcatatgcctgctgtacttccttaaaatgctcctcagcctcatccctgttcggattgttcacattcgcatctggatggtattttctgctgagtgctctgtatgccttttttatctcttcatctgaggctccccgcgatacgccgagcacctgatatggatctgtcatatatgtgtaacctcgctatttgcgcgcttttttcttattcttctcttccgccttgcgttttttcagctgaagatactcgtattttgaccatacgccggaatacagcacattccgcagtatatccgcatgtaataaaatcggaaggcgctcaaacgacttggcgcactcggacatcatgctcgtgagcagcagacggcagagcgtatccatgtcatccgcactctcccgcatcgcatagacgagtggattgtactcctttttcctgcgatcctcatcgtaatcctcataggcatccataatgtagatgaactttcccatgtaaaagccaagtgtgcgcagctcttcctgccactcatcctctctccagcagaaaatctcacccagcatctctccggtcagacctgccaccacatcaaggttcgtctcgcctcttgcctccacctcgtctgtttttcgcatgaactcttccactgcgtgaacctggcgcggatacttctctatcacgcgcgcatagtccttatccagcatctttgcaaacgccttcttcgtataggctttctcgtccttccagtcgtcaatcagattatgataggctacaatcagattcatatccgccgcataatctgtcgcctcattgatccacacctgccgcttcctggtcggatgcagcgcgcaggtaatctcggaggattcattcgtaagctcatacaagcccgtcagaagaacgatcagaaatgtcatatcatagttgagcagcatctgtccttttgcaccacagttggatttgagtctctggcacagtccgcagtaatatgcctgatatgccttccggttctcctctgtcatgatcttctgattgatatttatgtaaccgaacattccaagttctcctttgccctgccagatcagcttcttctgatgaattctctcctgcacttcgggcaggtaatacagattttgcctcttcccttcggcacccgcactctctgcctgcatccaggacacttgaaaaagcggtaggtatctctctgtgcgaagcgcttcttccactgatcccgcttcacaactgctttgtagcgcctgctcagataccgctgattctcctcgtaacgcttcgagacgttctttgaaaacatacggaaacaattataaatcatcagcgcaattccaaaccagtaaaaaatggaaagcaccggcagaagcccgctaaacatcgacacaaccagactcaccaataccacgatgttcaaggttctcccaagctcatccgctccataccgtccagtcataaaacgctgcagtttttctctcatatccattccttcctttccggatcatgagatcatgttaagccctgcaaaatagactgtcaaccttcctatcgtctttttagaaacattttagactttgattagatttcaggctgcctgtcaaaacaggcgcacctttctcctcatatcctccggatcttttgctcctgcgatcgccgtcccggacgtaatgcagctcttcatataaagattgtaaatcgcatcatccatctgcactctgccacgctccttctctgctccggcggacgtatccagctgctgtatccggttctccgcaatcagactgcgcaccccggcatccgccaccagaacctcataggcagccacgcgcccggcttcatcctgccgccgcagcagcttctgcgccatagcccccgccagtccctgcgccagactttccagaaggatctgcgaaccggatgtgctcccgccgcactgtaccagatggagcaatgccgccgtcacactgtcctccttctctgccagaatcacaaactgccctctcctgactgctgcaaacaaaagcccggcctcccgctcattcccgattccatccagaaggatcacatcggcatcctgctgcagcgccatcgcaagggcttcctccctggaagcgcagtccgctccgatctcccgctgcacaaccagtccccttccctgcggaaggatgtattctgtcgtatcctccacagagacaatgacctttgactgtgttgcggcaatctgtgcggcaagtgatgccaccgtcgtcgtcactccgcttcctctgcctcccgtgacaagaagcagcccgcgcccgtttttcacaagctccgtaatctcctccggtaacagaagtttctccggggcaggaaccccggtcggatgcagtcttacggacatggcatctcttccctgctgtctgtatatggacacacgcagacgcaacgctttggaaaatgaatagctacataccagcgcgcctttcgtgcggtactcttccagctgatccccggacaagatctgctccgtcacctctgtaagatccgcatcctgccattctgcggcgtcctcctgccctgcggcagtcagttctccgtcaatccgaagcatcgccgttcttcccgggacaaggtgtacatccgatgcacctttgccatccgcatattccataagatcattaaaaagttttatgccgttcatagaaaaactccttcttattgcttcatagggaaatgcaatgcatccccgcagagcgttttttatttctaggaaggttctactttcacacattaatgtatcacggtattccctatgaaataaaaagagccgctgcgcgactctcagatacttctatgtgacaatgataagcagaacgataagccgggttatgtctaaaccgtggcaagccacagtcggaatgatcatctatctaggatgactgttgccagccacctcaagcaacctacctaaagctggcgggccgcgtcaacgcttttgttcggtcttgcttcggatggggtttacatatgcccgctctgttaccagcgcggcggtagtctcttacactgcccttccacccttaccgtattccggcattaccggaaccggcggtatatttctgttgcactatccttggagtcgcctccaccggacgttatccggcatcctgccctgtgaagcccggactttcctcaccccagcaatgctgggccgcgatcatttgttctacttatcaccgcaactattgcttattataatgtgctttccgcaaaatgtcaaagcaatcctatacattgaagcaggaaccgccgatgaattcgcggataatcgaattctggctgataccgtcgctcggcatcggaaggaaataatccagaaacttgagcaggcgctttgcctccagatattccggacaatccttgtcaatggcaaacagcagcggctcggcatacatctttaacactgccagttcatagatcagcgccgagttaaacatcacgtccgccccctcctggaacgggaaaatgtagcgctcctcaccgcggcgcaccgaatcccacatggcaatggtctcctttgcggaagttcctctcgtgcgcgcatctctcacaatccggcggatcattctgccgtccgttgttggcaggcagttgtgctcgtcgatgttgagctgggtcagcgcactgatgtagattttgaacttgctctccaccgggagcgagcaggacagcctgtcgttgagtccgtggattccctcgatgaccagtacgtcctcttttccaagttgcatgtagcggtccttgtattcccgcttgccggtcttaaaattgaagaccggcagattgacgcgcttgcccgcaagcagttcattcatgtcgtggttaaacagctccacatccagcgcttccagacattccagatcgagttccccgttctcatcgcgcgggcactgatccctgttcgcataataatcatcgagagggaacggatgcggctttaatcccttcgcagcaagctggatagaaaggcggtgtgaaaaggtggtctttccggaggaagacggtccggcaatcatgataaactttttgcctcccgactttacaatcgtatctgccagatgaccgatccgttcctcaaacagtgcctcctgcgtcagaataatttcctgcatgcgtccttccgcaatcgcgtcattaagcgcgccaatcgtgccgatctctagcatgcgcccccactcacgcgaagccttcagcgtgtggaacagcttcccggaaggtgcaaactctgccacttctcttgtattctcattcgggaacagaagtacaaatccatcctcatacgtcacaatatcgtagtagcggagatagcccgtagacggcaccatgaatccgtaaaaatagtccttatagtgatcaagcacatagatattaactctggaactgcggcggtatttaaaaagcttttccttatcctccatcccgaggtcatggaacagtgcaatcgcatcatctgtgttcatgctgcgcttctcaatctcgatatcctccgtcaccagacggtacatctcctttttcagcgctatggcgcgctcttcgtccaccgcaatcacgcgctcctgtccgtctgccttttcacgcagctcgcagtaatatccctgaccgatggaatagagtacacggacgctgatatgttcgcttccccagagattgtagaccgccttctgcatcagaagcgtaacgcttctgcggtatgtcttttttcccgtcttatcggctgttgtcacaaacgaaagcgttccgtcccgctgtgccgtcttattcaattcccgcagccggttattatacaccacaagcacgatgtcatccggatatttttcctgatattcctgcgaaattgcaaggaaactggttcccgccggatattgtcttacttccccttcaattgtcaagctgaccatatctttccccatacgaatctctccccctctgccttttcttcaaggctttttgtcattcataatacgcaagcgccctggcgttctgcgcgaggatctgttttacgtcgtcaatccgggctgcaatctgctccgtcgccggctgaccggatagctgtgttaaaatatcctgctggatctgcgcttcccagcggagatacgccagaagcaccggatgtttttctgtaagaagctgctttccatagcggaattccagttcctgttcttctgtaaagctgtctgcatgagagactgcggaagcatcaaagtgaacgcgcatcatggggtaatattttccatcctccatgaccatctcttctctctctgtgacataaccgttctccatcagaaaacgccgcaccttcggaagctctgactgcggctgcaaaaccagcccatgtgcctgctcacagatgactctcccgctctccagaatatgtttgaccagtccgccgcccatccccgcaatcaggatggtgtccgcctcacccggctttagcgccgcaacgccgtccgacagacgagtctgtatgtagtcttccatgccgtacatccggatgtgttccctggcacgctccagcggtcccgtccggatatccatcgcaatcgcactggggatgtgctttcgttccaccagataaatcggtacatacccgtgatcggttcccacatccgccagccgctctccctctccgatgagtcctgccgccgttcttaaacgttctgatatttttaccatagattactccagataatcctttaatttgcggcttctgctcggatgacgcagcttgcgcagcgccttcgcctcgatctgacggatacgctcacgtgtgacattgaactcttttccgacttcctcaagtgtcctcgcacgtccgtcctccagtccaaaacgcagtgtcagcaccttctgctcacgctctgtcagcgttccgagcacttcctccaactgttcttttaacagggtaaatgccgctgcatccgccggtaccggaacgttgtcgtcctggataaaatcaccgagatggctgtcctcctcctcaccgatcggagtctctaaggataccggctcctgcgaaatctttaagatctcacgcacacgctccaccggcatgttcatctccgcagcgatctcctccggagtaggttcgcgtcccagctcctgcagtaactgtctgctgacacggatcagcttgttgatcgtctcgaccatatgcaccggaatacggatggttctcgcctgatctgcaatggctctcgtgattgcctgacggatccaccatgtcgcgtaggtggagaacttatatcccttgcggtaatcaaacttttccaccgccttgatcagtcctaaatttccctcctgaatcagatccagaaacaacattccacgaccgacatagcgctttgcaatgctgacaaccagacgaagattggcctctgccagtctctttttcgcctcctgatcgccgagctccatacgctttgccagctcaatctcctcctccgcggacagaagcggcacttttccgatctcttttaaatacatacgcaccggatcttcaatggagacaccgtccggaacggaaagatcaatcttctcgacctcaatctcatcctcatcatcgacgtcaagaagcatctcatcgtcaacgtcgtcatccgtaatacgaagcacgtcgatgttgtttgcctcaaggaaatcaagaatcttctcaaactgctctgcatccagctgcatgtcggaaaagaagtcgctgatctcctgatactccagcatgtttttcttcttttttgccagcgcaagcagttctcttaactttatctggaacttctcctgggcacttgccaccccgttctctgctcccgcatcggcagtttttgcagcagagttctccttgttttctcccagaacttccttattgtcggtgttttctttcttttttgccattttcgcttcatcctctcatagttcgttactattttgtccttaaatgcagattttcatccacattcctgcttctttgcccgctctcattcctccagcggaatatgaaccgttcccggcagctcattcttttcttttgccagagccgccatctcctgaacgtcaaacgtgtttgccagcttatgattgatgctgttctcccgcacgcggatcacggtctcgcgcagcgctttttcgcgttcctccctggtatccacccggtggattgtcgcgtttaagattcccgctgcctcccgctgctgctcctcatcctcgtaggtgctgatgatccgcgcaggattgactgtcccgtccttctcatactgttcaaacagcatttttgccacactgtggcagatcggatccgtaaaatcatctgcaccaacatatctttgcacctttggaaacaacgccggactgttcgtcagccacgtcagcagaagcttctgcgactgcaccatgccgtcctcgcgctttttcgcactctttttgtattctgtgcgcgcaccgtcctgtgcgtccgcgacgctctgcgacgccctgcctcctccggcaagtccggcctttaatccctgctggttgaccagccttctcaaatcgtccgacgagatcatgtatttggctgcaaccgcctcgatataattatcgcgctctaacttctccgtaaatccgcaaagcatcttcgcgaccgcattgtaaaaggccgtcttgccctccggatcgtgcatgtcgtgctgctgctcttccatgcgcacctcaaacagaaaactgttctccgcctggtcgatgcgctcctgatacgcctccgcgccaagcgccttgataaactcatcgggatccttatacggcttcatgttgatgatcttggtcgtgattccgacttcttttaaaatcgggatggccctgagcgccgccttgatccccgccccgtcgctgtcatacgtcagatagacttccttggtatagcgcttgagcagattggcatgaccgcttgtgagcgccgtaccgagcgacgccacggcattgtcaaaccctgcctggtgcagtgcaatcacatccatatatccctcgcacaagagcagctgcggcttttttgtcgcccgtgcgaaattgagtccgtaaagattgcggctcttgtcgaaaatcttcgtctcgggggaattgagatactttggctctccatctcccatgacgcgcccgccaaatccgatcaccttattgtgcacatccatgatcggaaacatggcacggttccagaacttatcatgtccgccccgcacctcatcgatcgtgacaagaccggaatcctttaagatctcgtcgtcatagcccttcgaccgcagataccggtacagatcatcgctgtactgatccgaatatcccagcccgaacttgtggatcgtctcatcggacaacgccctctttttaaaataatcaagcgcacgttttccgcgctccccgcgaagcagcacgaaaaaatactttgccgcctccttgttgatctccaaaagacgcgcccgccgatccgcctcctgccgctgcgctgccgtatattcctgcttcggaaggtcgacgcccgcccgctcagcaagcgcttccatcgcttccccgaacgtgtaattctcgtactgcatcaggaaggtaaaaacattgcctcccgcgtggcagccaaaacaatagtacatctgtttattgggagagaccgaaaaagaaccggtcttctcattatggaaagggcacagcccgaagtaggtactgcccttttttgacagccgcacatactgcgaaatgacgtccacgatatcgttgcgcgaacgcacttcttctatcaattcatccgaataacgcggcatcttccgctcctttcttcccgctttttatttccattctaatagccgtccacctgccaggccctgggacgcctcaggcatgacacagtcttaatagccgtccacctgccaggcctgaggcaaaaagtactccgaaaacttggtgatggcatactgatccgtcattcctgcgatgtagtccgcgaccacgcgctccgcgctctcgccctcgtccatcatgcgcagatattttgccgggagctgatccagatgctccttgtaaaagtaaaagagctgctcgatcatcgccttcgccttgacttcctctccctttgccacagggttcttgtagacgttctcaaacatgaacttgcgcagatcgatcatcgcctcctcgatctccggcgacatcatgatgtcatccttctccctgctgttcatgataatgttatgtatcagcgtattgaggcgctgcttggtggaaaaaccaagggtctttctgagttcaagcggaatatcgtcctccgttaagaccagcgcacggatcgcatcgtcaatatcgtggttgatataggcaatcttatccgaaaaacgcacaatctttccctcgagcgtatgcggcatcagtctggactgatggttcaaaataccgtcccgcacttcccatgtgagattcagcccctttccatccttctccagcttctccacgatacgcacactctgttcgttgtgccggaatccattctcgcagagcccgtttaacacgaactcgccggcatgtccaaacggcgtatgcccgatatcgtgtccgagcgcaatcgcctcgaccagatcctcattgaggcgcagtgcctttgcgatcgttctggcattctgcgatacctcgagtgtatgggacagcctcgtccggtaatgatcgcccttcggcgtcagaaacacctgcgttttgttcttgagacgccggaacgccttgctgtgcaggatgcggtctctgtcacgctgaaataccggtctgatatcacacggctcctcatacacatctctgcccttagaatgaatgctgagcgtggcgtacggacttaaggtctcgcactccattctctctatttcttcccgtatcgacatgtattatctcctctttttcgtcacgcactacgcagtgactccatatatataattctgcgtccggagtggatttcctctatttttttcgacacagtttgaaaaaatcatgtttccttgcgctaaaaatgctatactataaccaccaaatgaacaaggagtgtggtaccatggttttatttctgctcatcatccttattatgatttcggtatattggagaccaatgtggggaattctaagaggtctgctgctcggctttctttttttaatcgggggcagttctctgaacatcccggttccggtttcgtttgtggtatttgttctctactgccagctgggcaccccctggcttcgcaagacaaactaccggcagacaaaagcgacaagaacatttcacgaatcgacaaccaccgacgcggatcactccacgtacaccacggagcagtactattatgcctatgaggtggacggcacggattataccaacgtgcatagcatctatccgtataataagaagctgcatgcggaagccaaaagcgcagaatgtgaaattttctaccatccgaaaaagccgaagaagatgttctgcccggaagatatcgcaaaagattactacacgatatggattctccggttcctgatcggcggcactatcattgcaacagatttttatttttaatttattataaaatgagaaaggcaggtcaataagcatgaaaataacaatcgcaagacagtgtggaagcggcgggcacaaagtcgccgacattctgtccgaaaaactgggtatggagatttttgacaaaaaaagatttatcgaagagtctaaaagaagaaacgtctatgatgaaaacgcaaattttctgaacgagaaaccgatcgacagttttctttacagtcttatcatgagctacggttccaaaaatccgcgtgaacgatatatccgttttgtaaaggatgtcacggagcaggaatcctgtattatcatcggcagatgcgcaaacataatctacaaggatgacccggactgtgtgtccgtttatctccacgccgatccggacatacggaaaaagagaatccaggagcgcgaccacgtatctgaaaaagaggctgcggagacattgcgggaagtagatgaaaagcgttctgcatttcaggaacagtgcacggcaacccgctggggcgacggcaacgagtatgacctttgtattgatacagggaaaatcggtatcgagaaagctgccgaattaattttgcagtatatagaatacaggaaatgaaaaaacgggaagccttcactctcaaggcttcccgcaaataaaaaatgcaggagatgggacttgaacccacacgatattgctaccacaggcacctgaagcctgcgcgtctgccaattccgccactcctgcataatctccacgaatatttgtgatgtaatgcggaagatgggacttgaacccacacgttcgcaatgaacacaagatccttagtcttgctcgtctgccagttccgacacttccgcatttcggtcactcatcgtgacgacttgataataataacaaacgtattttaaaatgtcaatgcttttttcaaaaaattttaaataaattgttcaaacaattcgtgcaactacagatatttctcgtcaaactcctctttatgcagcggctttccaaagtaaaatccctgaatcaactggattttcgtctgcttgagcgcatcaacctgttctttcgtctcgacgccctccacacagacatgaacgccgatcgtctgggcaagttccgccaccattttcacgaaggcggcggaaaattcatccttcccgatgtcaatgataaaacagcggtcaatcttgatgacgtcgatcggcatttcccggatatgattaagtgaggaataccccgtcccgaaatcatccagcgccacacgcacgccaagtgcgcgaatctcggaaagaatcttcttcatccggctcatatcgttgatcgccagcccctccgtgacctccagggtcagattctccggtacaatccccgtccgtttgatgaccgagcgcacctgctctacaatgtcattctgcagcagctgcaccacggagagattgacatttaccttgtaatccggatgccccatatcgttccagtatttgcaccgcttgcacgcctcctcgaggacatacgcaccgatcgggttaatcagccccagatactccgccagcggtataaaatccgtcggagcaatcaatcccagttccccggaattccagcggatcaacgcctccgcacccacgcacggattggattccctggtcacatccacgatcggctgatagaccacctcaaactcggaaaatgcattgttggtcgcattgcgcatatttttttccatatcgaggcggcggaacgatgtggactccacgttctcatcgtagaactccacacggttcttgccggaacattttgcggcgtaaagcgcaatatccgccttcttgatcagctcctccaccgtgtcgccctctgtcggaaaacgcacaacgcccatactcatcgtacagtagtaatccgcccccttaagcatccacggcttggaaaacagcgtgcggatgtcgttcagaatcttctgcagcatcatgatctgccgatgtgcaagaataatgataaactcatctccgcccatgcggtaacagttattttccacacccggaatccgacgcaggctgtccgatatattttttaacaggatatccccgtactggtgtcccagtccgtcgttgatatgcttaaaatcatcgagatcgatgtagagcagcgctccttcgccgccgaactcctttgtctgttcaatgcagtgcgcaagatcctgctcaaaccgcatacggttgtaaagcccggtcaaaaaatcgttgtttgcctgccgttcgatcttctgctgatacagctttttgtccgtcacctcatagatggtatacaaaaatacacttcttccgtcgacccagtggattcctgtccggtgatagtcaaaccagcgtttttcctgctccagatagatctcgtggaagcagtccgtatcaatgccgcccgattcttcccgccagcagttctccaacatgtccggcgcggcatcgtccggcagaaatgcgcgcagccgctggttgctgtagagaatccttccactgaccggatccttcacatagattccgcagcccacgttctctaaaatcgcctcaagggacgcatacgaactcgccaacgaattttttgcaatacgcttcagaagaatactctgaataatccgtctgacatcgttgacgaacttgacgtccgtcacttcccagttccgctcctcgtgttcttccaaaaagcacaggtacatctccgccctggtattgacctcgaccggcagaaaaatgcctgccaaaagcccgtgcgcatcaaaaaactgccggaacacctccggcatcatactgtttgaagaaatcatatacggttttccgttaaaaaagggcatcttctcacgcgacacgccggaccattccccacgcactgagtccattccgggcgccgcatattcacagatcatctcgatcttcgagtgctctttgttctcttttaagagcgcaccgcgcgaaatctccatatacgcgcagcattcccgcagaatgtcgtgcacgatctcctcaaagctgttttccgactctaacatctttacgatggaagtcatcacctcattcctgtgaagttccgcttccatctgcgtctcagactcgcggctctttaacaccgcctcctgtgccatcagttcttccatcttcacggcgaacatctgcttggacaatgtctccagaaattccagtgacttatcataccgttccggcgtcgtgcgcatgacataagatggaacatccccgccttcccgatccataattccgatgacgatccagattgccgccgtcttcccgccgatcttgatggacacgccgcacattttcaccagatcatttccacaatcctcttcgagcacactttcgattccgtcatctaaaagccggttcatgagcgtcatatgccgttccactccggtcagtccgtgaatgtacgccagttcctccttagaaccgtatgcctttgtgacaactccgcgcgttctgctcagacacaccagatacacattattggcatcgcaaaaccggtcctgcagattctgcatcaatgtcgcatctaacaatcccagatcggtatcctgcgacgcttcctgattcatcccccttgaaagtgccatatcttcctcatcctttatactgaattacaaacagataaaactgatccttttcccggatacactgctcggcaagcagccggtaagcgcttcttatgcgaagctgttttctgataaatccctgctcattggaatagagcacaagaattccgtccgcttttaaaagtccggctgatttttcaaaaaatctgccgtaaaaagtgtccgtctcttcctttgactttcttccccggacaggcatattggtgatgatctcgtcaaatagatatgcatgtgtaaaatcaaaataatcacggttgataaaattgattttctcccccgcatatgatgcattctccctggctccccggatcgcctcgccaaagatatcaattccgtatttttcccgtgccgggacacggatatcccgctcgatcaacatcgtgccgacaccgcagaacggatcgagaatctgcgcgttttcttttaaatacggctctgccagcgccacaatcattgccgccgtcgccggatgaatcgaagctgccaccgcatttttgcggtaggcaaagcgtccatgcgcaatcgtaagaagtttcagaaagcaggcgtaaccgccgtctcttttctccagaagccgcagttcaatctcataatccgacggtgcattcacaagcatcctgccggacagccgctccagctccgcggaaaaccgtctggcaaacgtgctctttttgtctaacggcatgtggctctttatttccagtctgaaataaaacggcgtcgtctcccggtgcgcctgtgtaaggagctcccgcagattggaatcccagaccgcctccgcggctcctaaggcatcttccggcaccggctgcgccgtgcgcaccggaaacaataactcgcggtaagtccttatcgacgcaaacgggcggacgtccttcgcatgaaccagcacaccgagcgggtgcagtttctcactgcgtctgaccgatgcggacaccgcttttacctcctcaagcgtcacgccgcgctgctcccggtttgtcgcgagcagaaaatcctgcggctctgtgaatcccacaaacgtgtgacgggtaattccctccgccgccgtaatgatacgttccagttctcgcagttcctcattcacatgctttttctcattctcgggaatctcccgcgccaaaagtgcatccctgtgttcttttaacgcttccagatacggggatacctccatccctgacaaagccgtgagatacgcgctccttacgaacagcgtctgctctctctcgtatgcatgaaaaagagaacctgccgtctgtaaaagcccgagacttccaagcagaagcgccgcatttttgcgcaccttcggctcatcgctctccagcagtcctgtgagcagtgccccgtctcccaccagagacagcagggtttcccttgcctgtgggtccttgcactcgcttcgcagcagactcaagttctctcttatattctgattgttctgtaattctttataatattcgtgaatcataccgtatacctactacccttgatactaggtattctacgatatttcctcatttttggcaataccattcacatcaatgtaggtcagcaggtcctgcttgaacacaagccacgcatcctcatgctccacatagtatttcgggcacattttccccgtcacatcataatggcggatcacatcatccgtagtcaggtcatagcgtcccatcagccaggcggtaagctctatcagcgactggtaggtcgcatcggtaaactctcccgtctcatccggaatacagcactcgatggctatcgtgtcttcattccggtcattcgacgcgtaggcaatctcgttgcacggaatgcactgcacaatctccccgtccatgccgatgacgaaatgactgctggcatacgtctcccctgtgtctttcagattctcaaaatagctgcggttctgctccgctgtcgtgcccggattcgcagtatagtggatcacgatgccgttcacctgggaaagcgccgttcccggccgcgaatattcgttgtaatccagcagttctacctgatagtccggcgcctgtgccacatactttacctcgtacgccatcaccggcttttcttcatatagaagctttttgatctgtcgtgtgccaaaccagaccgccagcaccaaaagcagcggaatgccgatcaaaagcactatgcgcagccggcgtcttctccgaagccttttgcgccgtctacgccttttctcctcatacctacgccgttcttctcgcctgtatttctcttcctgttcctctcgcattgctccatcttcccatctgtccgttcattctgtcgtgctctctctgcggttccacgcgcgcctcttttttcattatgcacaattattttcgtgattttttacaaaatttttactatctttttgttgctttcttctaaaacaagtgctatactctgtcaaggaaaaagaaaggaggcgtatcacgatgaaatataccatagatccaactatgacttacagcgaagcagttctcttttatgaagaatatctcactgctgccaaggctgctgggaaaaagccggtatctttcctgcactttatcacaggtcgttactagaaggcttttcccttcttttttatcttacatcagatgagaatttctgtgttttaaatttgtcttaatttctcttaatttccactgaacttttaccgaataaaatttgttttcattgcaggttcccgctccgggaatgtgattcccgctgccgctcctgcctgaatacatttgagcagccatgccatattgctgcccagcgtgcgcatggtctgcagtccctctgcgtcctgccgtacctcgtccggcgtatttccgtgtacctggttccagtactgggaggaaaccaccggcatggaattgatcgtgaaatatttgttcagctgatcaaacgcggatgccgcgccgccgcgtctgcagctcaccactgctgcccccggctttccggcaaacacatttccctttccgtagaatgcgcggtcgagaaacgaggtgatggcaccggatgccgccgcataatgcaccggcgagccgaacacaaaaccgtccgccgtttttgctttctcaacaaattcattgaccggatcgtccacaaagcagcgtccgttcttaagacagacattgcagccgatgcagccggcgatcggctttgcacccacctgaaaaatctcggtctcaatgccgttcttctcgagagcccctgccacctcgcagagcgctgtataagtacatcccttttccctcggacttccgtttaccaatattactttcatgttctttcctccatcctggcagatttcctgccttctattctatgccactttccctgtgatcgtacgcttatgaaatataaagtgcttcctgccttgggtgggtcggaatcgctccattgatgttctccgtcttccctatgaagcaaagaaaagctgccgtatcatctgttccggtgcaaaaatatcctcaaactggaaatcctcctccaggaattccatattttcctcggaatgttctacttcctttgaatacagctttgccactgccacccggtcttccacggagaatgttcctccgttctccagaaaacgcagtgcatccatatcgcggatcatcagaatacccgccaccgcaaactgtgccttatttaaaatgttgtcatcataatacgatctcataaaataccggaatgtaaagtagaccagcagatgctcatactcatattcccttccctgctgcgctgcgtgaaagttcctgatacattccagataattgtcctcatggaatgctgcacgaagacgtttcttttcttcctcccagttctggtcgagcacttccagctgttcgtagcgctccatgcgtgcaagaaacgccgcatacgcctccccaggcgttacctctttctccctgcactcggcaatcagccggctctcacgctgctcttgctcctgcccgcttacttccccgcctgtgtggtatccgtaaagttcctgctgcatcctcttacaatatagaagatactccgccgcgcgctctgccaccggcttctcccggttctgaagcaatgccaccgccgccttagaaacggcattcagctgatcggcatccacagacacttcctcatcgtcgtcatacccctcaccgtcggaggtatcatcctcacacgctgcctcatcattaccgtacaatgccccgtcggcatcataagctgcctcggcgtcgtccccggtcccgcagaaatccggcatctcatgctcctgccaggtgatcttctcgtcggtggaaaacataatgtttccgacctcctcacatgccagacttaagatcttctcccggacgtcctcatactccatggtaaagcgtgggaactcggtgcagatctcgctcagtgcttcctcgcccatcttaatgcagatgtcgcagagctttttttcatttaaaaacgggcagtacccgtcctcgcgcataatcatggtgttctcctcaccctccctgatatgcgaggtaatctcttttcccagctctccgcccagactgcggtagtaatccatcgtaccctcatcgatgtcgatctcccagccatagcagcaattatccttgcactgatctgcaatacagtgaaacttttcatagtaagacggtacttttaatatcatcgtttgctcctgtctgcgcctcttcctgcgccattttatatccatttacggtgcaaaaaggtgcgtcatccgccgcacctttttgtaatcctactcatctttccggaaatgatcgctcaacatatagccgatacaccagacgcctcccgccagtgagagatacacaaacccctgcaccagtgcgaccgccagcttgatcagagacaaatctcctgccatatgcgccagaatcactcctctgaccggtcctcttaagatcatccatcctcctacatagaaccagccaacaacccccagcgtgtaaaaaaacaacgccagcaatgccttccatgttattttcatatctaattctcccttgttgatcctgcaataccgcgtttattgtaacacaaaccgcaggaagatgcaaaatccttccctcttctacatcagctcccggatctctcccgaccggcaatactctgcacagtcgatcacccgctggttggaagaccccttaaacagcagggatatatcatgaagctccgtcacaaacggtccgtccaccagcacatcgatcatgtgaagcagctccgcggtatctgcggtacagcattttccgcccggcacaagatcccggtctaacacatagccggtgtaggcccacacatccttccccggacactccgccttcactctccgcataaacggaagcagcgccttctgattctccggttcaaaaggatctcctccgagcagcgtcagtccccggatgtaatccggcttcaaggacgcaatgatctcatcttccacctctccggtgaaaggattcccgtattcaaaagcccacgtctccggctgaaaacagtctttgcagtgatttctgcagcccgacacaaagagaacggtgcgcacaccggttccgtttgcaatatcacaatatttgattgccgaataattcatatcttttctcctcaacagggaaagaaagactgtggctgcacaatcccgtgcacaccacagtccccctgtttttataaatgtaatacccgttccttgatctcctgtgttctgccctgattccagaactgcgttccaatatagccgcaggtacgtcttgccacgctcatcttgttctgatcgcggttgccgcagttcgggcactcccataccagcttgccgtcccggtctgtcacaatcttgatctctccggcatatccgcactccatgcagtagtcactctttgtattgagttccgcatacatgatattttcatagatgtactgcatcacggaaagtaccgcttccagattgttctgcatattcggaacctccacgtagctgattgctccgcccggggacagttcctggaactgtgactcgaactttaacttatcgaacgcgttgatctgctctgtcacatgtacatgatagctgtttgtgatgtagttcttgtccgtcacacccgggataatgccgaaacgcttctgtaagcattttgcaaacttgtaagtcgtcgactcaagcggggttccgtagagactgaaatcaatgtccgtctccttcttccacttggcgcatgcatcattcagacgacgcatcactgcaagcgcgaattccgtgccttccggctccgtgtgggatacgcccttcatatagcgtgtgcactcgcagagtcccgcatagccgagagaaatcgtcgagtaaccgtgatagagaagttcatcgatcgtctcgcctttcttcagacgtgcaagcgcaccgttctgccagagaatcggcgccacgtcggaaggtgttccctttaagcggttgtggcggatcatcaatgcctgatagcacatttccagacgctcatccatgatctcccagaacttcttctcatctcctccggaagagcatgccgcatccaccaaattcaatgtcactacgccctggttaaagcgtccgtaatacttgtgctttccttctttataattcttggcatgtgccagattgcccgtcgtgcggtctaccgtcaggaaagaacggcatcccatacaggtatagcagtcgccgtcttttaactttttcatcatcttctcagagatataatccggcaccatgcgctttgcggtacattcagccgcaagcctggtcaggtaccagtatttggacccctccctgatattgtcctcctcaagcacatagatcagtttcgggaacgccggcgtaatataaacgccctgctcattcttgacccctaaaatcctctgatgaagcatctcctcgatcactgctgccagatcgtcccgaagctgtccctccggcacctcatccagatacataaacaccgtgataaacggagcctgcccgttggtcgtcatcagcgtgatgacctggtactggatcatctgcacaccgcggttaatctcctctttgacccgcatttccgccatctggttgactttctcttccgtcgcctcgattccggcagtctcaagctccttgcgcacctgcttgcggaacttctcacggctcacctgcacaaacggagccagatgagaaagggaaatactctgtccgccgtactgggagcttgcgatctgcgcgattgcctgtgtggcaatattgcaggcagtagaaaagctcttcggcgtatcgatcatcgtctcgctgatgaccgtaccgttctgaagcatgtcctccagattgaccagacagcagttatgcatgtgctgtgcaaaataatccgcgtcatggaaatggatgattcctttctcatgcgcctctacaatctccggcggaagcaggaatcttctggtgatatccttgctgacctcaccggccatataatctctttgtacgctgtttacagtcggattcttgttggagttctcctgttttacttcctcgttattgcattccagcagacttaaaatctgctcatcggtagagttggacttgcgcaccagttctctcttataacgataagtaatatagttgcgggcaacattaaacgctttctgactcatgatctggttctccaccatatcctgaatctcctccacactcggggagcgcttcatattctcgcaggctttctcaacattggaaagaatcgcctgaatcttgtcgtctccaagcttttcataatcaatgacgctgtcgtttgccttgcggattgcagcctcgatcttgctgatgtcaaaaatgtcctcgctgccacttctcttaataatcttcataaccgttcagaatcctttctgttaattgctttttcattatacaatatctagtattgttgtcaatgcgttttcctagattctgtggttattttaccttttgaacaaaattaacaccaaaacttcgtcactttttattgttttggtttacaacaacatcttgtgtcttctgctattgtcacatccagattttgtagcatctgatccaggcagcgcttcaggtgctccacatcctcctccgaaagccccgccgtcaggcgcgcttccatctcccgtatatcgcgctccgcgccatccaaaagcgcagcggccttatctgtgagcaccagacgttttaagcgcgcgtcgtgtgagacctgggcgcgctcgatcagcccctttcgttccatcacggcaagcatattggacgccgtagctctcgagaccgagaacgcctcctcaatgtccctctgatagacctcccggtctgcgtgatcctttaaaaagccgagcgtccagcgctgcattcccgtcagattgtcctcgttttcctcccgttttgcttccatattcttatggagctggttgtggagcaggcgtattttgtatccgatggtctccgaccttttgattcgttccatctcttcctctcttctgtctgttttctaaaataatcattgacttctgtttttaattatcgtataacattattgttagcacactaacaattaaaaatcaacagaaaattcaaaaaggatgtgaaattatgttaaaaacacttggagcacagatcagggagttcaaaaaagattccctgcttactcccgtcttcatgattctggaagtcttcatggaaacaatcattcctctgatgatggcttccattatcgatcagggtgtggaagcgggcaacatccaccatatctacgtcatgggtgcctggatggttgtcgccgcctgtttctccctcttctgcggtgtcatgggcggaaaatacggtgcaagagcctccgcaggttttgcacgtaacttaagaaaagcgatgtacgagaacatccagagtttttcgttttccaacatcgacaaattcagtaccgcaggtcttgtcacccgtctgaccacagatgtgaccaacctgcagaatgcctaccagatgctgctgcgcatgtgtgtgcgtgcgccgatcagtctgatctgcgcgatgtgcatggcgtttttcatcagcccgagactggcgagcatctatcttgttgccgtcatcattctgggcatcattctcgccatcatcaccgtgcgcgcgcatcactattttatggaagtttttccaaagtacgatgacctaaatgcctccgtgcaggaaaacgtatccgccatccgcgtggtcaaggcttatgtgcgtgaagattacgagaaaaacaagttccgcaaagccagccagaatatttacaacatgtttgtcaaggcggaaagcattctggctttcaacaacccggtcatgcagatcaccgtttacagctgtattcttgcgatcagctgggtgggcgcaaaaatgattgtcggcggaacattgacaaccggagaactaatgagtcttcttacctattgtatgaatatcatgatgagcctgatgatgctgtccatggtgttcgtcatgctggccatgagtgtggcaagcgccgagcgtatctgtgaagtattaaatgagaagagtgacatcaccaatccggaaaatgcggataagaccgtgccggacggaagcatcacctttgaccatgtgaccttccgttacagcaggacatccgcaaagccagtgctctccgatattgacctctccataaaatccggcgagacgatcggtatcatcggcggaaccggaagttccaagtcctcgctcgtcaacctcatcagccgtctctacgatgtatccgaaggccgtgttctcgtcggcggaaaagacgtccgttcctacgatcttgacaccctccgcaacgaggtctctgtcgtattgcagaacaatgtgcttttctccggaaccatctatgagaatctccgctggggagatgaacatgcgaccgacgaagaatgccgtcacgcgtgcgaactggcatgtgccgacgaattcatcgagcgttttccggatggttacaacacctacatcgagcagggcggaaccaacgtctccggcggtcagaaacagcgtctgtgtattgcccgcgcgctcttaaagaagccgaagattctgattttagacgacagcaccagcgcggtggacaccgctaccgatgccaaaatccgtcgcgcttttctcacggagattccaaacacgaccaagctgattatcgcacagcggatctcctccgttcaggatgcagaccgcatcattgtgctggataacggagagttgaacggtttcggcacacacgaagaattattgcagaccaatgccatttaccgcgatgtctacgagtcacagaccggcggcggcggtgattttgatgaaggaggtgctgcctgatgccacagaatgaaaaaaatgcaaagccgatcggcggaccgggcggccgcggcggtcacggtcccagaccgaatgtcaagaatccgggaaagctttttatgcgcctgctttcctatattatgaaaaattatgccgtacactgcgtcattgtcgtgatctgtatttttatcacggttctcgcaagtgtgcagggaacctggttcatgcagaccttaatcgacggctatatcctgccgctgatgaagcagagcgatccggacttttctggtctcgcacacgccattttacgcgttgccgtcttctacggcatcggcgctatcgcagcctacatatacacaagaattatggtcaatgtctcacagggtactttaaagcatctgcgcgacgacatgttcacccacatggaagagcttcccatccggtattttgacacacactcccatggagacattatgtcaacttataccaacgatattgataccctgcgccagatgatcagccagagtatgccgcagtttttgaacagcatcatctccatcgtgagcgtctttatcagtatgcttcttctcaacattccgctgacgctcgtcacacttgtaatggtcggtgtcacactgtttgccacaaagaagatcggtgccttaagtgcccgctactttatcgcacagcagaaagatattgcgacggtcaacggctacattgaagagatgatgaacggtcagaaggtggtcaaggtcttcacccatgaagaggaaagtatcgccgatttcaaccggctcaatgaccagctgttccacagtgcagacaatgccaataagttcggtaacattttaatgccggtcaatgcacagatcggtaatatcagctacgtgctctgcgcgatcgtcggcggtattcttgctctgggcggatatggcggatttacgctcggaaagctcgcaagttttcttacctataataagagcttcgggcagccgatcaaccagctctccatgcagcttaacaatatcgtgatggcactcgccggatcagagcgtatcttcgctctgctcgatgagcagccggaagtggacgacggctacgtcacacttgtccgcgccagacaggagaacggacagattgtggaatccaaagagcgtacgggtatgtgggcatggaagcacacccatcaggcagacggcagtatcgattatattgaattaaagggcgacgtggtatttgatgatgtcgatttcggctatgttccagagaagaccgttcttcacaacgtagatctctacgctacgccgggtcagaaaattgcctttgtcggcagcaccggcgccggaaagacgaccatcaccaacctgatcaaccgtttctacgatatccaggacggcaagatccgctatgacggcatcaatatcaacaagatcaaaaaagatgacctgcgccactctctcggaatcgtgctgcaggacacccatcttttcacggctacggttatggaaaatatccgttacggcaagctggatgccacagatgaggaagtcatggcagctgccagactcgccaacgcagatacatttatccagcagcttccgaacggctatgacaccctgctgaccggcgatggtgccaacctaagccagggacagcgtcagctgcttgccatcgcaagagctgccatcgccgatccgccggttctgattctggacgaagcgacaagttccatcgatacccgcaccgaaaagattgtgcaggacggtatggataagctgatggcgggacgcaccacgttcgtgatcgcgcaccgtctctcgaccgtgcgcaacagtgactgcatcattgtcctggaacagggacgcgtcatcgagcgcggcagccacgatcagctgattgaaaaacacggcaaatactatcagctgtataccgggaatttagcggaaggctaaattcccgtgtaattccagcggaagatgaaactcccaaaaaaatagaactgtcgcactaagcatagcgtgctttgctctgataagtaatattattagaggaccacaccgtgggatttcagatggaaatgcagccggaaattcggttcaaaaaatgtggaatttctaaccaaccgaatgtttgcatcttcgatgatccgtgtctttccaagtttggagcactccgcgggtcatgtccgcatcccggagacaatttgtaggacttttgtgtgtgtcccttattggcacctctgaacaaaacataaccgcgcgaagccgatgtctgaattgccatctgccatgtttttaatagcagatggcaacgagtttcggttcgcgcggttttatatcgtctgtgaagaggtgccattagggacaccagaaagtccgcccattgtctccggtgtgtcggacatgcacccgtcggattatccaaacgtggaagagacacggaatccgatgcaaacattcagccggaagaaattctcacatttttctcaaacgaatttccatctgcatttccacatgaaatcccgaagtgcgtttctcataatattacttatcacccaaaaaaggtctatgcttattgcggcaatctattttatgagggattcctaatctcctcaaacttctcccaaaatccttcgacagtctccccgccggagcagatcttatccgccagtgtcacgatccatgcctccctgcagcacggcggaatcggattgagcggaaacatatgccgacggatcgtctccttctcaatctcactcagttcaaaatcttccatcgcattctgcagcgcttttcctgcatgataaaatccatgccacttatgggaatcgtccttctcatgccagtcgtacagaaaatagtcatgcagtaacgccccgcggatcagcgcatggcagttcacgcggattctatacttttccgcaatgtaaaaactgacgtacgccaccgccacgctgtggcggaatacgctcgtggaaccatgctgcataaaccggctggaggagagaaacctggaatttttgcatacctccgtaagaatctcccgaaaaactttctcattctcttttgacaaatgaatccgcttcttttttctgtccatttcccttaaacacttcctctgtcagatctgataaccaccggatctcattcggctgcatggcaagatcaaaaccacctctgtttcaagtcctacctgtccacttcgattgtgattacaattccatctcccgcatcttcctgaatcgcttcctgcacaccctgaatcacatcttcctgcagcgcatccttgttagtagaagattttgcatacattttgatctccggattaccgagacttctcacatcatcccacgtaaattcagccagattgatcccggtcgggttattcaaaatctccaggtcatccatatcacagtagagttccattccatgcagcgtgcacactgctccaaaattctgggagtctccgttttcatcctcatacttatacgttgttgtcgtgctgcgtatcagacgctcgatctcatagataatctgcccccatacctgtgatgccatccagtcgtcatcctcgtatgttccgtttgcgaccagatacgtgctgatataccaggagtgggaattgttatatccgtaatcaatgctgtaataatcataggtgtcgtatacgtatccgtctaaagtaggatgattattgctggtataatagtgttttccgtttaccttatcttccttctcggtccttgtgatctcatacccgtccggcaaaaacgatttcagaacgtcgccgtatttccgctccagatgatagcttttatgatatccgcagccgccaataaggctgactgctgtcagacatgccagtgccactctgtatttgcagtgcaaaaaatgttttttctctctgcttaactgcatcattttctcttcctgtcctatacgttattgtctaatatacttcggcttattttaacatatctaattacaaacgtgcaagtataacgcacaaaaagaatcgcagtccatggaaacatgaactgcgatccttctatgcattacacaatctgctgatcggactgattatttgtacagctctaccagtctctgtaagtgctcgtaacgagcctttgcagcttcctcggaagccttgaacagtctttctgctctctccgggaatgctctggtcagacggctgtaacgtgtctcgttgttcaggaaatcctgataagaaccgtcgcccggcttggatgtcagagtgaacggattcttgccctctgccttgagctgcggattgaaggagaagaggttccagtaacctgctgctactgctttcttcatctcatcctggcagtggttcataccaccctttacaccgtgcagctcacatggagcgtaaccgatgatcagagacggtccgttgtaagcctcagcctcagcgataaccttgacagcctgagccatgtttgcaccgagagcgatctgtgctacatatacataaccgtagctcatagcgatctctgcaaggctcttcttgccaacttccttaccagaagctgcgaactggcaaacctcaccgatgttggaagccttggaagcctgaccacctgtattggagtacatctcggtatcgaataccataacgtttacgttctcaccggaagcaagtacgtgatccagaccgccgaatccgatatcgtatgcccaaccgtcaccaccgaagatccatacggacttcttagcgaggtaatctttcttctcaactgcagcctttgcatccgggcatccggctgctgctgccttctctaactctgctacaagagctgctgctgcaggagtatttgcctttgtatcgttctttgtctcaacgaacttgtcaaatgctgcctttaactcagcgcttgccttgtcagatgttgcgcacttctctgcagaagcgattgcctgctcacgaagtaccttctgaccgatttccataccaagaccatgctcagcgttatcctcgaataaggagtttgcccatgccggtcccttcttggaatctttgtttaccgtatatggtgatgtagctgccggaccaccccagatagaggaacatccggttgcgttactgatgtacatatgctcaccgaacagctgtgtgatcagacgagcgtaagatgtctcagcacatcctgcacaggaaccagagaactcaagcagcggctggttgaactgggatccctttacagtgttgtctgccggcatgccaggcttcttgcctacgtttgctaccaggtaatcgaataccggctgctcttctgcctgagactcctgcggaaccatctcgattgcgcctaccgggcagacagtgatacactcaccgcatcccatacagtctaacggagatacgctcatggtgtacttgtactcgcttgccttcggctttgtatctgcaagcttgatgttggaaggagctgccttcacctcatcctcgctcagcatgaacggacgaatggttgcatgagaacatacaaatgcacactggttacactggatacacttctcagcattccatgtcggaacggttacggctgtaccacgcttctcatatgcagcagcgccaagctcgaactgtccgtccgggttctccttgaatgcggataccggaagggaatcgccatccattaaggagatcggctccattaagtctcttaccatcttaacagtcttcggaagacccttaagctctgcaggagctgcgtctgcctccggattcttccaggaagccggaacctctaccttatgtactgcgtctacaccggcatcaattgccttgtagttcatctctacaactgcgtcgcccttcttaccgtaggacttcttagctgcagctttcatgaactctactgcctgatcgatcggcataacgtttgcaagtttgaagaatgcagactgtaagatcgtgttggtacgcttgcccataccaatctcgattgccttgtcgattgcgttgattgtatataactgaatgttgttctctgcgatgtacttcttcgcatctgcattcagatgatgagctaactcttcatcagaccactggcagttgatcatgaatactccgcccggcttaacgtcctgaaccatcttgaatcccttggttacataagacgggttatgacatgcaacgaagtctgcctggttgatgtagtacgggcttctgattggcttgtcaccgaatcttaagtgggaaatggtaacaccaccggtcttcttggagtcatactggaagtatgcctggatgtacttgtctgtgtggtcaccgatgatcttggtggagttcttgttcgcaccaacagtaccatcaccgccgagaccccagaacttacactctacagtaccttctgcagatgtgatcggagccggcttaacctctggtaagcttaagttcgtaacatcatctacgataccgattgtgaaacgagccttcggagcatctttctccagctctttgtatacagcgaatacacttgaaggaggtgtatccttggaacctaatccgtaacgtccgcctgtcaggacaacagtgtcgagaccagcctcacggagtgtggttgcaacatcaaggtataacggatcaccaagtgcacccggctcctttgttctgtcaagaacagcaaccttcttagctgtcttaggaagagcctttaaaaatgcctctgatacccacggacgatacagacgaacctttacaagtccgaccttctcacccttagcggttaagtagtcgattacctcttcagctacgtcgttgatggaacccatagctacgataacgcgctctgcgtccggtgctccgtagtagttgaacagatcatagtttgtgccaagcttctcgttgactttcttcatgtacttctcaacgattgccgggagttcattgtaagctgtgttgcaagcctcacgatgctggaagaaaacatctccgttctcgtgggaaccacgcatagccggatgctccggattcagtgcatgtgcacggaactctgcaactgcatccatgttgcacatctctttgagatctgcataatcccacttctcgatcttctggatctcatgggaagtacggaatccgtcgaagaagttgatgaacggaaccttaccctcgattgtagcaagatgagctaccgggcttaagtccataacttcctgcgggttggtctcgcacagcatagcgaaaccggtctgacgacaggcgtaaacatcgctgtgatcaccaaaaatatttaaagactgggtagctacggtacgcgcggatacgtcgaatacacaaggaagctgctcgcctgcgattttgtacatgttcgggatcataagtaacagaccctgagatgctgtaaaggttgtggtcagcgcacctgctgcaagggaaccgtgtacggcacctgctgcacctgcctcagactccatctctacgactttgacctgattgccaaaaatattctcctgtcctgctgcagaccactgatctacggtatctgccatcgggctggaaggtgtaattgggtaaatagctgcaacatctgtaaacgcataagctacgtgagctgccgctgtattaccgtccattgactgttttgctctggacattattattcctccttaaattaaaatagagtgtcatattccgacttaagactaattttagcatttaatttgtcgattgtaaaggtttcagactgtacgaaaacgtgtgcaatctacatttgtcatgttctgtttgtccctggtcagatatactttttttcaaactcctccaggggcagcgggcggtcaaaataatagccctgaccgtagttaaaaccgcactccatcaaaaacgtccgctgctgctcctcctcgattccctcaaaaatcacctcctcctttgccgactggatgaactgccccatctgatagacaaaagcactctgtccgttctggtggattttgtcggtaaagctcttgtcgatcttcactacattcgccgggatttccaacagcacgctcagcgacgagtagccggttccaaaatcatcgatggcgatgcggtagccgagtttgccaagtctggtaagacacgcctttaagctgtctaacttctccacaatcacactctccgtcacctcgatctctatgtagcacggatcaatcccgtaccgctgcagggtattctgcaggcgttcgataaaatcgtcgccgccgttctcaaaatttctcctggaaaaattggtggagatcgtaaacagttctcttccggaatccctccagcggcgcattgcccgaagcagctgttccagaatataaaaatccagatccacgatatagcctatattttccagtgcagggataaaccgtgcgggagacagaatctcgccggattccagacgccagcgtgcaagcgcctcggcgccgtagacccgctcctcgcggagcaggaacttcggctgtaaatatacctcgaactcgccccgctgcagtgccgcgtaaaatcttccggtaatccggattccctcatcacgttttttcctcatgtcatcccggtaaacgaccgctcccacattctgctccttggcaagctttcgtgccagattggctccctccagtatcttctcaaacgtctcttccccgtcatcgataaagcagattccagccgaaagctgcatggctcccgccggatagcggatctttaactgttcgccaaacatctgatcctctctctccacaagccccagaatgttctttttgtccgttcctctgaccaactcaatgaaataatccgaatacattctacaggcctccacgacatgggactcgctgcggattaacgctgcaagctcctgcagaatactgtcgccggcctcctgtccataattttcatttacataggcaaagttgttcacgtccagatttaccagcgcgtacaccatgttctcatcctgcgcaagcccaccgctctttaattttttccggatcagcctgcggaatgtgtccagattatacagttccgtcagcatatcctgattctgcagatgccgtatctctgcctggtcatcgctctgcctgctgcgaagggagacaaatacagcaaccacccgcgcgagttcactgagcatccctgcttcctctttggaaaatccctctgcactgctgcttcccacacacaggcagccacttctgttaccggaaaattcaaactttacatttccacagtttttgatggaagttccatgatatttctccgcccccaactggggaacctccgttaatatatcttccgttggcgtcgagacaaaacgcccgatttccgcctcccggaacactgtaaccgattgtgggaatacctgttgttccacccggctgccatcccggttccagtaattcatcaacaccatttcctgctgttcttcccggtactcaaacaccatggcaaagcccagcccgtattttttcccaatctgttcgatcagcacgttcaaagatccgttgatatctttcgcatgcgagagaaggctgaacgcaaaattcaggaactctttatccaccttctgcccgctttccggagcatattcaatcctgtcgcgcctgcgctcccgctctgctccctcttgctgctttttgcccgcaaacgaatagtggtcttttccttcccgcttcgtggcatacatcgcccggtcagccatcgcaaacagggtctcataatctcttccatcctcgccgtatactgccatgccgatgctgagcgtcacctcaacgatggcgtcgtcgccgatcagcttttttctggcttcccggcccagcgccgcggcgcacgcttctgcctcctttggagccacatcccgcatcagcgccagaaattcatctcctccgactcttgcggtgacatctgtctcctgaaactggctttgcagcacgccggcaatatcagtaattaccgtatctccgacggtatgcccgaatgtatcgttgatccgcttaaaattatcaatatcgatcaggaacagcacatgctgtttttccggctcactttttaaaatccgttctacctctccggatgccgccaccttattataaagccttgtcagcgggtcgcgcttcgcctcctccgacagttcctcctgaatcctgcggtcggagctgacatcgtagctgcgtccgatgatgcggataatctgtccgttgtccccgacaatgctccggtaaatcgtccggtaccacacatatacaggttcctccccggcagccgccacattcatccggtaatcaatacttcctgtccgcacatccctgctggctgcctccagcaccctggcatacgcggcacgatcctcctcgcagatatccgcgagcatctcctcataatccatatatctgcgccctgccgttcccggctgcccgttcccgcgatatttgcgcggcaccctgaaacgccgctgtgcaacgtcgtactctagcgggaattcatcggtgacctcttctaacatgctgtactgctcctccatcaggcgcagttcttcctccagattcttccgcttgtctatgttccagcttgccaggatatagtaaggtaccgcgtcccggtaataatacagtctgcaccgcatcagttcccagcagacgccgccgctcttcgtacggatgcgcagttcaatctcctccgtggttcttagttcccggcacacttcgatggcatcctcgaacacaccggtatcgtcccggtacaaatactccacaaacggcgtatttccggtcagttcctccctgtcatacccctctgcatgcaaaaattcccggttcaccatctcaatatacagctcattcccgccgcggactaccgctattccgaccggcatcttgccgatcagatcttttctctgcccccgctccatgtctattgtatttatttgcgtatccccatactccataaaatcaatctcctgagatgcaatttcctctgtcatacttaagataactccgattgccttcccgtacattatatcaaatttttaacgaaatccaaacaatttgtcacagcgtgaaagccctttttaataagaagttccggttgcatttctccgtattttttagtatgatacgaattggtgcaataaaagcaggtgatttacaagaaaagttaggagaacataaatatgatcagtacaagcaacatcactttacgaatcggaaaaaaagctctctttgaagatgtcaacatcaaattcacagagggctgctgctacggtctgatcggtgcaaacggcgccggaaaatctacgttcctcaagattctgtccggccagcttgaaccgacgagcggagaagtcatcatcacgccgggtcagcgtctttcctttttgcagcaggatcattttaaatatgacgagtacacggtactcgataccgttatcatgggcaacaagcgtctctacgatatcatgaaggaaaaagacgcgatctacatgaaagaggatttcacggacgaggacggtatccgcgccagtgagcttgaagccgagttcgcagatatggacggctggaatgctgaatccgatgcagccaccatgttaaacggtcttggcatcccgacggaggatcactacacgctcatggcggatatgccaagtgccttaaaggtcaaggttctccttgcacaggcgctcttcggcaacccggacattcttcttttggatgagccgaccaaccatctggatctcgatgcgatcagctggttagaagaattcttaatcaactttgagaacacggtcatcgttgtttcccacgaccgctacttcttaaacaaagtctgcacaaacattgcagatatcgactacggaaagatccagctctacgccggcaactatgatttctggtatgagtccagccagcttctcgtaaagcagatgaaggaagccaacaagaaaaaagaggagaagatcaaggagctgcaggaattcatctcccgtttctccgcgaatgcttccaaatccaagcaggcgacttccagaaagcgtgccctggaaaagattcagctcgacgaaatccgtccgtccagccgtaaatacccgtatatcgatttccgtccgaaccgtgagatcggcaatgaagttctgaccgtcgaaggcattaccaagaccatcgacggcgtcaaggtgctcgacaatgtctcctttatcgtcggacatgacgacaagatcgcgtttgtcggaagcaacgagctggcaaagacaacgctctttaagattcttgccggtgagatggagccggattccggcacctacaagtggggcgtgacgaccagccagtcctacttcccgaaggataacaccgagatctttgataccgatcttctgatcgttgactggctgacacagttctccgagatcaaggatgcaacctatgtccgcggtttcctcggacgtatgctgttcgccggagatgacggtaccaagaaaatgcgtgtcctctccggtggagaaaaagtacgtgtcctgctttcccgcatgatgattatgggaagcaacgtgctgatcttagatgaaccgaccgaccatctggatatggagtccatcaccgcattaaacaacggactcatcaagttcccgggcgttattctttttgcctcccgtgaccatcaggttgtccagaccacagcgaaccgtatcatcgagttcctgccggacggcacctttgtcgacaaggtatccacctacgacgaatacctcgagaatgatgagatggcaagaaaacgtcaggtatactccatgtcatcggatgacgagggcgataactaagacccggtcttttttacaaaatcacacgggagcgctgtgtcaggaaaaatctccggcatagcgctcccgttttctgttcttctaaattctgttttcactcccgccgattccgcgatcctgttctccggcgcccctacgcttccttaggcttccggtactctgcctcccgcataccgagcgcaaacgctcccataatacccggattttctccaagtgccggcggcacgaggtaggtatcgatctcctttaagattttctcattggaaatatacccgcccagcagttcctgcactttcgtgcgcaccattgaaaagagctggctctggtgcataattccgccccacagcacaatcttctgcggagaatacgtcagaacataatttgcaaccgcctccgcgagatagaacgcctccatctcccagacatcctcccggtccgccagttcctttgccggtctgccccagcgcgcctccaccgccggaccgcttgcaagcccttccagacagttggcatggtacgggcattttccggcgtaggtgtctttcgggtgacgctgcagaagaagatgtcctgcctccgggtgcaccagcccgtgcatgagcgccccgttacagtagacgcccacgccaacgccggtgccgacggtaatatagattgccgtgtcgcagtcttttgcggctccccaggtaacttcgccaagcaccgccgcattcacgtccgtatcaaatccgaccgggacgccgagcgcccgtgtaaaagttcccaccatatcgacattctgccattccagcttcggcgtgctggtaatatatccataggtcggggacgcacggtgcagatccaccggtccgaaacacccgattccgagtgacgagattccttttccctcaaaaaacgcagccatgcgcggcagggtaatcttgggcttctctgtgggaatcgtcacacgctctgtgattgtgacctgattttctcccggctgtcctttgtctgtctgcacttccccgatcgcgcacaccatcttggtgccgcccgcttctattccaccaatccgcatccttctcttcctcccttttcttatatataccacttcggagttctctccgccagtcatatttcaaagaaccggaatatttaagagacagcagccctcccggatgaattagaaaattctccgcaccgccagcacgctgcggtaggttaccggagaagtcagcgtaatgcctgtcttttcattgctcgcatgaatcagtgtgttattgcccgcatagatgccgacgtggccgctatagcagacaatgtcgcccggctggatttccgacaggctgacggcatatcccacactccgctgttccgacgatgtgcgcggcagattgattccaaatgccgcatacacgcccttgacaaatccggagcagtcggttccgtttgtcaggctgttgccgccgtatacataagggtttcccagaaactgtctcgcgtaatcgaccaccgcctgaccgttggaggaagccgtctgcgcactttgccccgcactgcttccggaaccgcttcccgcgctgcctccggaactgcttcccgcgctgcttccggaactgcttcccgcactgctgcccgcgccggattttttcacctcctgtttttctgccgctttgcgggctgcttcctgttctgctgccgcacgtgccgcctccgcctctctggctttgcgcgcttcctccgccgcacgggctgccgcctgccgttctgcttcctctctggcaagccgcgcctcttcctccgcttttgactctgcatgaatgtactctgtggacagcgtcacataatccagtgccacataaccgtcaccgtccgcggtggacactttcgcccagccttccgtcgactcgtcggttaccacaacgtcatcgccgtccggcagcatggtaagcaccttcgcctcggttgtcggctccgtccgcacgaacagggtcgtcgttgtgacggtcgccaggcgcgttcccacacttctggcaagctcctcatcccccacgaccacatattccgccttgacatatccgttcacatttccggacgtaatccggtaccacccgtcctccgtcgtctccagcacagtggctgcggatttgtcgtaaagttttccaagaatttcactctccgtatccggttcctgccgcacgttgacatagtgattcacctgcgccactgcaatatccgcaaactctgacgcggtctgcggaagttcattttccgcaatctccgccgtctcccacgcttcctctgccaccatctccggttccatcatccgcgccacagccgcgttactttgcagttcctccacaacatccgccgtctgcgcctgcactcctcccgcttccttaagcacctgtgccagcgtctgtgtcacgcccgccaccggcacctcacgtttttcctgtcctgcctgcaccattccatagcttcccagtgtgacggctcccgccagcagaagcgccagtattgtcattcttttcttcattatgtagaatcctcccgatttattccatatgcttccatattgttacttatttgttacaaaaatatttcatttctgcaacaaccgtattgtaacaaaggaaccacatggaatctacagggaactctttccatttttcgctctcttttgtccggtctgccgctttgtcccgcaacgcaaaaggaacccaaaggttctttcgtccctgcgggttcccttcgtattttccttccggtttaacctaaacttccttactaatagcagaagctgtgtccgccgatcttttggtccagtctcggcgtcaacggttccgtagaaaaatataacgtatcatttcttaatatatgtgtatttccattcaatacctcatgaatcgaagtgtattccttctccgtggggtttgcccgctctctgttcttccaggaacagaactgcgtcgggtttccctgactgagcacgtcatacaaggtatctggatatttttcggaagccatccggttaaaaactacctcgaccacggcttcctgcccttctgtcggctcgccctgcgattccagccagacgatttttgccaacaaatctatctcctcctgcgtcaatgtgatattccagcggttctctgcaccggccgtcgtctctgccgtcgcaggcttgctctctgccgcctccggcgcctctgcttcctccgatgctgcctgtactttggcttccggcgtctctgctttctccgatgctgcctgtacttcttgtgccgcatcggacggtgccgcacttgctaccattgttctggggttctttgtgattcctgtcgcttcatctgattctgtcgtaaatgaatatccggataaaacacggcacacacccgcaaccggaacctcagttccgtctgccgcagaaattacatacgcgctgctgatctcttctctgctctcccgtatcgtgttcttctcctcaatgttggccgcaaccataagacaaatgcataaagtgcacagcattgtcacgtccaatatttttctgttcattttgctcctttcctcaagaatgatactctgtgagctgctctcgcactcgttgtttcatcatactagattcttcccaaaagtcaaatttcccattcacaaaattccagaaaatttttctttacattttcccagaaatgcggcaaaagcgtgttctgtcgtatccaatacttccgaggaatgctttgatgtgttaaaatagaactgctcaaactcacaaaaaaaacatcccgaaacgggatgttttctatattccttccaatattcctgcgcggtttctgctgtcgcaaatcccgccatttttgtaccttttccggcacaatcttcctcggctaccgtgtgagaaacagttcttcaaacaccgggattttgtgttccggatccgcctgaaagatcgcaacatgcgcatcgtctgtgctcctgtcggcaaatgccggatataaaaacccgcagaccggccgccccggctcgtactctcccaccaacggagcgactgcaccgatcagatattcatatacctcctccgactccccctgccgctccttgtccgatgcctttaccggcacatcatagcggtcgtgaaagaccagaatcgcatacggctccctgctacggtaccgggcacccacaagctcataaaacgtgtacagcagcgcatcatttttcagtccgcactcgcgcattccgtacaacaactggcgcattttcctctgttctgcgccatccccgaatgcgtagctgcgcaggtttacattggttgctgcaaacggaaccgctttggcaatcgccagatttttctccttttccgccgcagacagattgagaaagttcacattaaaactctcatcgatctctccgtccggctccatatagccgcctgccacacgcgtaaaggaagtacggctgggcgtcattctgcgtgtcagctccagcatatcttctctgtttatcataatttctcccgtcccgtgtttttatgataacatttcattgccggcacatccatgcttgtcttcaccacacttatgttccgcgcaggaatgctcatgctcatgatgagaacatctcacatcgggattgtaatctaattttcctgcaagataagcttctaccgcttcatctgccgcaccggacactccaccatacagctttatgccggcagttgcaagtgcgctttgcgcaccgcctccgattccgccacagatcagcacatccgcacccgcctccgtcaaaaatccggcaagtgccccgtgtccctgtccatttgtgtcgacaatctgggatcttaccacctggctattctcaatatcatataatttaaactgttccgtgtgtccaaagtgctgaaatatttctccattttcataggtaactgcaattctcatccgatctgtttcctttctttgaatatcatcttttccgacggacgttgaggtgcgcctgcatattttattgcaacaaaacagggccgttccatcacacaatcgataattcccgcctgaaatctccagtgtctttccgtttacgatgctgtccgccattttatatctggctgactcataaatttcggtcactgttgtgcgggcaatccccatctgcttcgcacattgttcgtgcgtacacttctcaaggtctacaagacgaatcgtttcatactcatccatcgtcataatgactttttcccttgccggaacaccattcgggcaaaaattatcatatgccgcttccatacagattcttcttgcttttgtcggtcgtgccatcttttctcctcatgcctatttccgtcatatgtcaaaaactattataccgcaattttccttttttcacaactccctatgaaaattgatatactgaccgtctgccgccatcacaatgcgatcccgtttacaatctgtaagaatatgtaaaacgcccgtattgtgatcccgcctttgcatatactatcctgtaggaggtgagatcatgatcgcctggtttctttatctgatcttaactgtaaaaaaagattcttcggctcagaattgagccggctgtttcatcgtaggatacaaatagaaaaatataacgggaaaaagattcttacagaagggaaaagaaaggatatgatataacatgaaatgcagcacagcatgaaaaaaacaccgaatttacggtgtttttagagcaggggatgagagaatcgaactcccaccaaaggttttggagacccctatcataccatttgaccaatcccctatatttataaaaatgacgtatcagatacgtcatttattatcttactagatatctcacaaaaaatcaatggtatattgtaccttcaaaacttcatacagaaatcatccaacaaactttttggtcaagccctcgatcgattagtaacagtcagctccacacgttaccgtgcttccacctctgccctatctaccttgtagtcttcaagggatcttactcacttatgtgagggatatctcatcttgaggggggcttcacgcttagatgccttcagcgtttatcccttccggacttggctactctgccatgccgttggtcgacagcagatacaccagtggtccgtccatcccggtcctctcgtactaaggacagctcctctcaaatatcctccgcccgcgccggatagggaccgaactgtctcacgacgttctgaacccagctcgcgtaccgctttaatgggcgaacagcccaacccttgggacctgctacagccccaggatgcgatgagccgacatcgaggtgccaaaccactccgtcgatgtgaactcttgggagtgataagcctgttatccccagggtagcttttatccgttgagcgatggcaatcccactttatgccaccggatcactaagtcctagtttcctacctgctccacccgtcggtgtcgcagtcaagctcccttctgcctttgcactcttcaaatggtttccaaccattctgagggaacctttgagcgcctccgataccctttcggaggcgaccgccccagtcaaactccccgcctggcattgtcccaccgccggatcacggcggctggttagaaatccaatactgcaagggtggtatcccaacagcgactcccttgaaactggcgtcccaagttcttagtctcccacctatcctgtacatgcagtaccgaatcccagtaccaaactggagtaaagctccatggggtctttccgtcctggcgcgggtaaccagcatcttcactggtacttcaatttcaccggatgcattgtcgagacagtgctcaaatcattacgcctttcgtgcgggtcggaacttacccgacaaggaatttcgctaccttaggaccgttatagttacggccgccgtttactggggcttaaattcaaagcttcgcttgcgctaacctctcctcttaaccttccagcaccgggcaggcgtcagcccatatacttcacctttcggtttcgcatagacctgtgtttttgctaaacagttgcttgagcctattctctgcggcctgcgttagcaggcaccccttctcccgaagttacggggtcattttgccgagttccttaacaatgcttcttccgccggccttaggattctctcctcatccacctgtgtcggtttacggtacgggcacacatgaaacaatagcggcttttctcggcacatggctcacacgcttcgctactttaattcgctccacatcacgtcttcggattgcctggcggatttgccaaccagactccttctccgcttgtaccggtatttccattcccggctcgtgctctccacatgcgtccccacagttctgttcatatgtggtacaggaatctaaacctgttgtccatcggatacgtctttcgacctctccttaggccccgacttacccagagcagatcagctttactctggaaaccttggatattcggccgagaggattctcacctctctctcgctactcattccggcattctctcttcttatccctccactgctccttccggtacagcttcgtcggtcttaagaatgctcctctaccaatcactacgtgattccacagcttcggtgttgtgttttagccccggacattttcggcgcaggacctctcgactagtgagctgttacgcactctttgaatgtgtggctgcttctgagccaacatcctagttgtctttgaaatcccacatccttttccacttaacacacactttgggaccttagctggtggtctgggctctttcccttttgactgcccaacttatctcgtgcagtctgactcccattcatcatctacatggcattcggagtttgatattctttggtaagctttgacgcccccgcggaaattcagtgctctacctccataagactaaaatgaggctagccctaaagctatttcgaggagaaccagctatctccgggttcgattggaatttctcccctacccacacctcatcgccacccttttcaacggatgtgcgttcggtcctccattgccttttacggcaacttcaacctggacatgggtagatcacccggtttcgggtctacggatactgacttgacgccctattcagacttggtttcccttcggctccacaccttaagtgcttaaccttgccggtacccgtaactcgccggaccgttctacaaaaagtacgcggttgtgcatataaagcacttccacagcttgtaaacacagggtttcaggttctctttcactcccctcccggggtccttttcacctttccttcacagtactatgcgctatcggtcactaaggagtatttaggcttacggggtggtccccgctcattccatcaaggtttctcgtgtctcgatgtactctggattccgccatgtcatctttcctttcgcttacggggctttcaccctctctggcaggctttcccaaaacctttctgctaggattgacgaatcaattatgcggtccgaaccccggaatgcacgcattccggtttggcctctttccatttcgctcgccgctactttggaaatcgatgtttctttctcttcctccggctacttagatgtttcagttcaccgggttcccctccatacgttatggattggcgtatggatacatgaggtatgctcatgtgggtttccccattcagacatctacggatcaaaggatatttgctcctccccgtagcttttcgcagcttatcacgtctttcatcggctcttagtgccaaggcatccaccctgcgctcttttttgcttgacctcgtttacagtttctatagcgttagaaactgggtctttgcgtttaataacgcggatcgaattgcttcgatcttgaactttcgttcgtttgatttggtcgtaaactttgtttacgatattctcggatgtcttgataaaaaatcattttcatcaaaatcttctgtatgaagttttcaaggtacaatagcgaacttcgttcgcattagaaattgcttcgcaacttccgtcaaacggaatgttttgcaatttcaatggagatggtgagattcgaactcatgaccccctgcttgcaaggcaggtgctctcccaactgagctacacccccaattaaaatatgaaatattttaattttaatctggcagccacctgctttcccataccgtcgccagtatagtatcatcggccgcttaggtcttaaccatcgtgttcgggatgtggacgggtgtttcccctaagcgtatcgccaccagaaatatgaagttgtcattcgtatctgctcctttgtactcatgactcgctcgattccgctccgcttcatcttgctagagtcattcgtccaatctgtcttcgcttcaacaccggcttgcaaatgaatttgcaccgttgtctccgctcatccaggcagatactcattgataactaaacagtgaacaaactctctacttgatttccttagaaaggaggtgatccagccgcaccttccgatacggctaccttgttacgacttcaccccagttatcagtcctgccttcggcagctccctccttgcggttgggtcactgacttcgggcattaccaactcccatggtgtgacgggcggtgtgtacaagacccgggaacgtattcaccgcgacattctgattcgcgattactagcgattccagcttcgtgtagtcgagttgcagactacagtccgaactgagacgttatttttgagatttgctccccctcgcgggattgcttccctttgtttacgccattgtagcacgtgtgtagcccaagtcataaggggcatgatgatttgacgtcatccccaccttcctccaggttatccctggcagtctccctagagtgcccggccgaaccgctggctactaagaataggggttgcgctcgttgcgggacttaacccaacatctcacgacacgagctgacgacaaccatgcaccacctgtcaccactgctccgaagagaaagtacattacatacttgatcagtgggatgtcaagacttggtaaggttcttcgcgttgcttcgaattaaaccacatgctccaccgcttgtgcgggtccccgtcaattcctttgagtttcattcttgcgaacgtactccccaggtggaatacttattgcgtttgctgcggcaccgaagagcaatgctccccgacacctagtattcatcgtttacggcgtggactaccagggtatctaatcctgtttgctccccacgctttcgagcctcagcgtcagtaatcgtccagtaagccgccttcgccactggtgttcctcctaatatctacgcatttcaccgctacactaggaattccacttacccctccgacactctagtccgacagtttccaatgcagtaccggggttgagccccgggatttcacatcagacttgccgtaccgcctgcgctccctttacacccagtaaatccggataacgcttgcaccatacgtattaccgcggctgctggcacgtatttagccggtgcttcttagtcaggtaccgtcattcttcttccctgctgatagagctttacataccgaaatacttcttcgctcacgcggcgtcgctgcatcagggtttcccccattgtgcaatattccccactgctgcctcccgtaggagtttgggccgtgtctcagtcccaatgtggccggtcaccctctcaggtcggctactgatcgtcgctttggtgggccgttaccccgccaactggctaatcagacgcgggtccatctcataccaccggagtttttcacactggatcatgcaatcctgtgcgcttatgcggtattagcagtcgtttccaactgttatccccctgtatgaggcaggttacccacgcgttactcacccgtccgccactcagtcacaaaaacttcattccgaagaaatcaattaaagtgcttcgttcgacttgcatgtgttaagcacgccgccagcgttcatcctgagccaggatcaaactctcatgttatagtttgtttccttttccagaataatctggcttattcagatgttactctgaatttactgttttaggttgttctttataagaacgttcgtctgtctttcaatctcttgatcgacagcttgaaatttaggatctttcaaggtttattcactgttcagttatcaatgtacatcgtcaatacttcgtattgactttagaagttgctccacaacttccgaacggatttttcaatctcattcatcgttgtcatctctcggcaacagcttatttactatatcataccatcaaccgtttgtcaacaactttttttattttcttttgcttctttttcagaagcgctttgcctgtccgctgttctcgcggtcagcttgtttatattatcatcattattttagaatgtcaaccacatttccgccgttttaaaaaagaaagttttcggttctgaattgttctaattgtgcatacaattcagaaccattcgtttttcttccacggactaccgcatcacataatccatcgcatccttaaccgtgcgcacgccgacaagaccgattcctttgatctcctttaagctctccctgcacacctccggcagaatacatgtcttaaatccaagcttcttcgcctcgagcacacgctgctctgccatgctgaccgcgcgcacctcaccgctgagtcccacctcgccgaagcagatggtcttctcgtcaatcgggcggtctttatagctggagacgatcgccagcacaagaccaagatcgatcgccggctcattcatccggatgccacctgcaatattgatataggcatcacaattccccagcgaaagtcccagacgtttttccagaaccgccatcagaagatttacccggttaaaatccgttcctgccgccgtccgcctcggcataccgaaattgctgtggcagaccaacgcctgtatttccagaaggatcggtctcgtcccttccatcgagcatgccacaacagacccggaggcgccctccggttttccgctcagcatgaattccgacgggttctccacctctgtcaggccatctccgcgcatctcaaaaacaccgatctcgttcgtcgacccaaaacggttcttcacacctcgcagaatacgatacgccgcatggcggtccccctcaaaatagagcaccgtatccaccatgtgttccaacacacgcgggccagccaccacgccttcctttgtcacatgtccgacgataaaaatggaaatcccaagtcccttggcgatctgcatcagggtgccggtcgattcccgcacctgtgagacgcttcccggcgcagacgagacgtcttcattatacatcgtctgaatggagtcaatcacgacgatctcgggcttctcccggtcaatcacgcgccgtatggtatcaagattggtctcacagagcaggcttaagctgtccccaaaggtcccgatgcgttctgcccggattttgatctgctgcaaggattcctcaccggaaatatagagcaccttcacctcatgttccgcaagattcctgcatacctgcaaaagcagcgtcgattttccgattcccggatctccgcccacaagcaccagagatccctgcacaatcccgccgccaagcacccggtcaagctccttcatgccggtggacacccgctgttcctgtgtcatctcgatctgtgacaggggaactgcctttgcctcacggctgccatccgtgctgcggttcccacgcgcggtctttttctcaaccgtctcctccacaaacgtattccactcatggcatgcgggacactgtcccatccattttgccgactcgtatccacattcctgacagaagtatactgttgtttttccttttgccatgttcttatcttcctttcccgcagacacgtctgctgcccggacagggctttttctccatagaaagcgcggctttcgccctttaacctaacacgtcatttcctattagagtaacaaagacctgtccatacggacaggtctcactgatcttgtaactgtcatatgcgaaagcggctgctctagcacttctggacgcttacctttaccggagcatcgccgagctctacgctcaggcttaactttcctccgagattcgtcttcatcctgccggcatctgcaccgtcgatcacgatgtcatactccgcctcatcctcaagctctacggtaacctgtgcgtcctctgcgccctctacgctaaactccattcctgtgtctgtcgcttttaaatgctccactgcagtccccggaacagactcgtatacaaacatgccattgcgctccagcttggtaatctcctgacaggtctttactttgtaaagatctccctggtgttcaaaattgtcaagctttgccttggtgctcaatgtgtaatccccaaagctgatcgttccatcctcctctgaacggagtaattcactaataacggccatcttatcctcctgtgatattgcagctccttcatccggtctgctttatcgtaaatttgtaaaaatattatataatatctgttctttgatttccagtgatttcactgacatttaagtaattttttactttttcttggactccagaaaaattgcatttttcttcgtcgtgacgatcacttcgtcaccccgccggatgcttccgtcgagaagtttttccgcaagcggatcctcaatctcatcctgaatcttgcgccgcagcggtctggctccatacttcgggtcatacgccttatccacaatgtactgctttgcggcatcgcgcacgacaagtgtaatgccaagttgtgtttcacagcgcttcgccagttcttttgtcatcagacctacgatctgtttcatgtcgtccttattcagcgccctgaatacaatggtctcgtcaatacggtttaggaattccggtttgaaaattctgcggacctcctccatcacgctgcccttcatccgctcatagttctgcttctcgtcattgccggaagcaaagccaagcttcttcggctccacaatcgcctgcgctcccgcgttggaggtcataatgatgatggtattcttaaagtccacttttcttccctgggaatctgtgatatgtccgtcgtcaagcacctgcagcagaatattaaacacatccggatgtgccttctctatctcgtcaaacagaatcacggcgtatggatttctccgcactttctcactcagctgtccgccgtcctcatgtccgacatatccaggcggcgaaccgatcattttcgacacgctgtgtttctccatgtactcagacatatcgatgcggatcattgcctgctcctgtccaaagacagcttccgccagtgccttggatatctcggtcttgccgacgccggtcggtcccagaaaaaggaacgagccgatcggacgcttgggatcttttaatccgacgcgtcctctccgcacggctttcgccacagctgataccgcttcctcctgtccgatcacgcgcttgtgaagggttgcctccagttttttgagtctggcagcctccccctctgtaagcttcttcaccgggattttcgtccatcccgacaccacatcggcaatctcgtcctctccgacggtctggtgatgccgtctgccgccctgttttgcctttgtattcagtttttccaacttttcttccagttcctggcgttttgcctgcgactccctcgccgtttccaggtctccgccggaaagtgcttcctccaatgtctcctgcaactccgcaatctcccgccggagttctgcagcctccttggggtctccgcccacatgaaggcgcacttttgccgcagcctcatccatcaggtcaatcgccttgtccgggaggaatcgatcgttgatgtaacgcgcggaaagacgcactgccgcctccacggcctcatccgtaatcgtcacatggtggtggctctcatactgcccacgcagtccctttaatatggaaatggcttcttcctccgtcggctcctccacaacgactggctggaaacgccgctccaaagctgcatctttttcgatatatttgcggtactcttcgatggtcgtcgcgccgatcacctgcacctcgcctctcgcaagtgcaggttttaaaatgttggatgcatcaatcgcgccttccgctccgcccgccccgatgatggtatgaatctcatcaatgaacagcaggacgtttccagctttcgccacctctgccagcaccttcttgatgcgctcctcaaattcacctctgtactttgagcctgccacaatcccggaaagatccagggaaaccactctttttccaagcaccgtatctggaaccattccgcccgcaatgcgctctgcgattccctctacaatcgccgtttttcctacgccgggttctccgatcaggcacggattgttcttgcttctccggcttaaaatctggatgacgcggtcgatctccgtctctctgccgaccaccggatcgagctttccggcgcgcgcaagttctgtcagatctctggaaaactgatccagcgccggcgttccctccgcatttctccgctttccgggttttccgttctggaattcatccttatactggcttacatcctcgcccatcgcgatcagggtgtccacatacattttctgcacattgacagacaatgtattcaacagtctggacgccacacattccgtctccttgatcatcgcaattaaaaggtgttctgttccaatcttctccgagtggaaacgcgccgcctccgctttggatacctcaagcacatgcgccgctctcggggacaatccgtcctccagaaccgcaaccgcattccccggtgcaatcagctcctcgatcagttccagcaccttatcatactctacaccattgtcggcaagtacctggcttgccacaccagttccctctttcaacaggccaagcagtatgtgctccgtgccgatataactgtgatgcaatgactttgatatccgcgttgcaatatcaatcgccttttttgcctttgctgtatatgctgtctgcatcgctacctcctatttccagtccgatatcacattcgtctttacagatcattaaaatctatgatatccagctcatcgtcttgcttgtttttctggtctttgccgcctgaaactttttctttttcatcgtccggcgcatcgctgtccccgtacgtgtcatcgtcatccccgtacgcgtcatcatccccatacgtgtcatcgtcatccccgtacgcgtcatcatcctcgtacgcgtcgtcatcatcaaacagatcgtcatccagatcgtcagacttccgcttccagaaaccgaatctcttcttcggcggctcttcctcctcgatgtcatcctcatcgaatgcatcatcgaacgcgtcatcgtcagattcctgcgttttcgttttctcttctctctcttcctgttcgtcgaattcatctgcatccccggcatctgcagcagagcgcttcttccagtgccactttttccgggaatccttttccggttcctcgatcacatcatcctggttttcatccagcagttcttctgtatcatcatgctctgagacaccgtcatccataatgtcatcctcatccaggtcatctctatccgcttccctcctgtgcagtaacaggttaacaagtaccactgccattaccgccagcagaaatatcaatatgccaatcgcggttctggaaaacgctttttcttttttatatttctcggacagcgccagatattcctcctgcagataggccgcatcctcgtcctgcagtccgtcggaagatacagttgtccctgtatttacgcgctgataggtctcctctatggagtcgtactggtaccagccttccgttccgtcagaattcactccgtaaaaggtatagaactccgattccacctcagacccttcctcctgggtctcctgatatgccgtcacaagacttccgtccgccagcgtaagctgtgtctgctgcatcgtatccggcatcgtataatccaccggtggcagaagcgctatcacatagtgttccccattgaccatttttacaaacggatacagggtatctcttgtgctgtcatatacaaagaagcttcctgtgctctcttccgctccgtcctgcaccagataaagcatgaccacagatcccttgtcataactcacgccccgataatccgccccctgataattgacggttgtctccgaaaaatctgcaggaacattctctgttgcaaaattttctgcaattacataggaaatgccatttgccgtaaccgtgttttcactgctgtccgtctcctctgttgtctccacttccccctcatcggatgccgttgtctctccggacgaggttccctgctttgtcacattcacggtataggttgcggtcacgccattttccgccttgactacaatcttaatggtgttatctccacttttcagattggtatttcccgtaaccgactccacgaccgctttttcattgaccggtgtggcagatacggcgatattggttacatcgcttcccactgtagcactataagtcagcgttttcccgttaaatgccggcgagagcgttcccgttgaaatggtcaactctttcagagaattatccgcagactgttttcctgttgtctctccagtattcgccgcagaatccccgtttccacccgctgatgttccgtttccgttggaggttccactgttactgctactattattgcctgaatctgtatttgtacttgctgcattctttactgtgaccgatgcactgctgcccgacatggaatccatctcctcattggagtcaaagatcactccgtcgttggcagagacagagagggaggaatttcccgcactcacagcttttaatgtcaccgtgtagctttctcccgtcgccatcacgcttccgccgcctccgccgtatgtggtattgcaactcacaaactgcagcacactcgaatcataagacagcgtcatggtcgcattcgccttttcgccggatggaccgctcgcttttactgtaactgtaaccgtatcaccgatattgacacttcctgacgacaccgagacagatgttgatccgctcgccgcgaataccgtctgcggcactccgacaaccccgaatgtcaggctaagcgccatcatcatcattgctatttttttcttcatttctgctctcccaattcttcctctcactgatcaatctgtgagattcccagtatgtgtttttgtaaaataaccagatccttattggaaataccgccgtccttgctgacgtttgccgcttccagacgactgccggactgactttcaattccaaggatctgtttctgcatcaataccagatccagattggaaacctttccgtcaccgttgatatctccatataccacaatctcatactgctgcacgagcgtgtcgccgacatacactgccagcttgttgcccgttcccaccgtctgtgtattctcactgccgtctgcattcagaatctttacggtacagttctgggttccgattcccgatgcgactgtggatgcgcttgttccaggctcaattcccgtcacataggttccgatcggataggatggcgtaatcgccgcgtcatccgccacctgaatggttccgccggcactgccccccgctcttgccacgatcagcgtgtaagtgcgcgaatctccgctctgcgagatgcaggtaatctgaatcgtattatctccataattcagcgaataatttccagtaccggaaacggttgacgttcccgccaccgccgtcgctcccacattgatcgaagccgcgctgtccggaacgaccagggaataggaggtattcgcaccggaaaatgccggtgtcagcgcatatccgtccaccgtgatcgaggaaagccagttgttcggattccccttgtccgcaaacgtcactgcgctctccggcatgttctgatagaccggaatgcggaaaacaaacgcctggttcttgtccgtgtaggcttttcccatattggtgccctcactcatcgccgcctgcacattggtcatgtactgatgtgcgtaaagactattggtatagacaacgttaaatttttcaaagtaaatggtattctgcccttttttcacataattatcagccacaaccgatgatccacccgcaatcgacttgtagatggagttccatccctgcaacttcgcatattccagtccgttcacaatcgccgacgcgctgcccgtcgtaaacgcacggacgttaaagtagttataatagcctgcatagttggaatatcgtcccgaaatcagatcgctcgtcccccgcacgccctgctcctgcttacagcgggatgccaggtggtaagggctcacgcccacattggagccgatctccacaaacgtatccgcatagctgcgaaccgctccgtccgtatcggtataattgcctgccataaatgtattggaaagaacgctctgcacacccgctgcgttctgatagcctgcatattccaacgtttcaaactgaaagatctgattctcgttaagaaaatttctgggatcgatgcagtatgcgatatattccggagacgccgacacccagcttgccccgtcaaacccgtaccacttgttggtctcccagttatacgcctgactgtccgtcgattttcttgcgtcattcacggaattctggatcaggtttcttccgaccagactctcattcgataccaccgtattccagtcaagtcccgtctgcaccggcacaaactgccagttcggatacttctgatgcagggatgccagtgcgctgcaatagcttgccggaaaacccgctgccgcaagcgccgcctcatactcgctgtccgtgacaccggtcgtctctccctgcgactggtcgtctgacgtctgaccgttcacggctacatagtccgcacaaatccacccggaataggaggcgcctccgaccacgagcgtcacactgtaccagttcattccgcccgccgagaccagctcgcccacattcacagcctgtcctttgtatacctttgtcaccacagagtaggacgttcccgctcccgagcgcacataaacacctttttccgtgttctgcaccaccccgtttgtcccacctgcactgctgtccgcattcgtctgtcccgcagaagaatccgtgccctgaagcgtcacaaaatccgagcgtatataaccggttacaccatccgacatctggatctggtaccatgtatacccgtctgatcctgccgtctcatcagttactgtcaccgcatttcccggatagagcagtgtcagcttatccccggtcaccggtgcgttgcgcaccttcaccggtccgtcattgatcgttcccgccgtcgccgtgtacgcatatacggcttcggggccgtgaaaagcagatatgctggcagcaagcactcccatgctgattgccgccagcaatatctttctcttctttctatatataaagtgattcatcgaattcctccctgagtaccgcacaagtccataaaatcatgcgcccaataattcagtctcattataggagattctatcacacgcgtcaacctaaatatagccattttcctgcacgctgtactatatttagacgtttttcgacatcaggttccggttctgtatcagcaggcttccccataatatgccccagagcccgcacacaattccggtgagcagtacagcattgcactcctgaaactggattccgaacagcagaaccacacccgtcaccagtccgaacgctccaatcgccgctataagcgcacacaaaagtatcaattccatatccactgttttcatcttcttatcctccttttctaacctgccagataccgttcccactcctgcttcgtcatccacggccagcacgccttgtcatcgatatagacgtccgcggagatttttctggattccgttccatactgttccaacgtctgcgccacattttcatttaccgcatcaaattccagtccgaacattctgcaccaggccaccgcctcctccagcagatccccgcagcggcatgtccacaaaattacttttttgccctgccttctcgcacccttgagcaatgcaaagagcggcagattcggcatcccgatggcaggataacattcactgcacaatgtcccgtcaaaatcgacggcaatgatctcgatctttttctccatgttcttccctccccatccgctttgatggtgtcagtatcgcacatgatgtgtccaattctttggacacttgttatgtaaacccatatttacaggacaaaaattgtcgcacgaagcatagacctctttggggtgataagtaatattatgagaagaccgcaccgtgggatttcagatggaaatgcaggtggaaattcggttcaaaaaatgtggcatttctaaccagccggatgtttgcatctgcgatgatccgtgtctttccaagtttggagcactccgcgggtcatgtccgcatcccggagacaatttgtaggactttcgtgtgtgtcccttattggcacctctgaacaaaacataaccgcgcgaagccgatgtctgagtcggcatctgccttattttcaatagcagatgccggcgagtttcggttcgcgcggttttatattgtctgtgaagaggtgccattagggacaccagaaagtccgcccattgtctccggtgtgccggacatgcacccgtcggattgtccaaacgtggaagagacacggaatccgatgcaaacattcagccggaagaaatgctcacatttttctccaacgaatttccatctgcatttccacatgaaatccccaagtgtgtttcctgtaatattacttatcaaaccaaagcacggtatgcttcgtgcgacacccccctttatctttatctctatacgatgtttttctgctatgcgttatacgccttcgccgtcaaacgccgggatgaagctctcttctgccgtctccccctcctgaataaatccctgctctacccccagtccgatcgcataatcgacgacctcctcatattcctcgtccgtgactttccggttcagctccgggtaggcgctgacattttccaacggcgtatactggttcatgatgctcagatatatctgattgccgtaggtttcatacaggtattttatcaccgccttagagtccctggtacagcccggcagcagcaggtgacgcacgataacgccctgtctcatcagaagtccctcctcgatcgggtcttctgcttcgtctccgtcaaacacgggtctcgggcactggcgcaccatctccgcaaccgccgctttggccacgtcggcataatccggagcgtgtgaatattttgcactgagcgccggacttatatatttaaagtccggcaggtagatatccacaagtccttccagacttttgatcgtatccgcactctcataactgctcgtattgtaaacgacgggaagccgcagtccttccttttttgcacggcgcaatgcctccgtaatctgcggtgcaaaatgtcccggcgtcaccagattgatattattcgcccctttttcctgcagttccaggaatatttctgccagacgctccttggtaatctcctttcctgccgtcccgtttgcgatgctacggttctggcagaacacacaatgcagggcacagccggagaaaaataccgcgccggagccgcttttcccggagatgcagggttcctcccagtaatgaagcgccgcacgcgcaaccttcagctgttcggtctgtccgcagatgccgcgctctccgcccgcacggtccactgcgcagtttctaggacacaatgtacacattttcatctttccgtccgtctctttctatctaaattcaatcttgataatcccgcgtattttgggtatgataatgtttgatttccgaaatgaccattttcggaacaatctgacattgatatatttacacataaggagttcgttatgaatcagaaaaattgtatggtagcccagtccggcggtcctaccgttgcgatcaacgcaagtcttgccggtgtcattgacggcgtgtccgcctcttccatgtacgacaccgtttacggctcgctcaacggaatcaccggtattttaaacgatgaccttctcaacctcacggagcttatggacggtcatccggaatatctttcccgccttgcgcagacacctgcgatgtacttaggctcctgccgctacaaacttccccattatctggatgatgattcaccctatgtcttcatatttaagcagtttgaaacttaccacattgaagcgtttttctatatcggcggcaatgattccatggacaccgtgttaaagctgtccgagtacggaaaacgcatcggcagttccgtccgcattatcggcatcccgaagaccatcgacaatgatctctgcgagaccgatcacaccccgggctttggctctgccgcaaaatacattgcctcctcgctcttagagatcgcgcacgacacctttatctacgcggtcaaaagcgtgaccatcgttgagatcatgggacgcgacgcaggatggctgaccgctgccgcggcactcgcgcgcaacggatacaacaccgccccgcacttaatctatctgccggaagtcgctttcgacccggaggatttccttttagacgtcaagcgtctccttttcgagcgcaacaatgtcatcgtcgcagtgtccgagggcatccgcgacgcctccggcaattacatcagcgcgtccgagcagtccatcgacacgttcggtcacagtcagttaagcggcgccggcaagacacttgagttccttgtcaaggaaaagcttggtgtcaaggtgcgttccgtggaaatcaatgtcctgcagcgctgtgccgcacatctggcttcccagacagacttagacgaatctttcgcactcggcaaaaaagccgtcgcactctccgaggagggtgtgacagcttccatggtcaccatcgagcgcacttcaaacgcaccgtataccgtggattactcctatgcggaaatccgccagatcgccaacgaggcaaagagcgttccgagagagtggatcaacagtgccggcaacgacatcgaacagcctctgctcgactatcttgctccgctgattcttggcgaatcgcaggtctcctatcacaacggtctgcctgtatacatggatgtgagccacctgtctaagcactagacaggtgctccctattcccggagcagaatctcgataaatttaccgatctcgacccacgcttttctggattccggcagcatctttgctgccatctggaaaatgtggaacatcccgtcatagatacttaagcgcacttttacgccctgtcctctcgccttcgcggcgacatccacagaatccgacaacagcatctcatacgatcccacctgtatcagcatcggcggaaatcctctgaaatcgccaaacatcggtgatatatattcatccatcgggtcgtggtctcccacataatcccgattgtagatcaggctgtccctggtctttccaaacaggggatccctctcgtagttggtatcgtaagactccccgcttgccgtcagatccgtccacggcgacatggcaatgattccgcacggaagctgtctgccgtgattgatcagatagtggcagagtgccatcgcaagtccgccgcccgccgaatctcccgccacaatgatctgctccgaaaaccatccctgcgcaagtagccattcatacgcgcacacggcatcctcgagcgccgccggatacggatgctccggtgccacgcggtaatccggcgtgagcacgctcatgccgtggctgacctcattgtacaatccggcaaacatgcggtatgcattgcgcatcgccccgacatatccgccgccgtgcagctgcaaaatgattttgtcgcggttcgcattctccttcgactctaaaagctccatggtaaaatgttccatctcgatcgtctgcatggtaaagcattccggacacttccacggaggttccgccgttccgatctgtttgcggagttccccattttttatctttttcccaatcagcaaatcattcgtcgtatgcgcgatcagatccctcacgactctgccgcggatactcgcctcattttctctcattcactgtacctctgttctattttccgctgtcagaaaacagctgcgccgccggacagcaaaacagccgcgtcagcggacatgaaatcttcgccgcagttccgtccttgccctccggtctcctatgatcagcgtacccaaaaacagtgccgtagaaaatgcaaacgccagcaaggcaagaagcggcgccgtcacgatccccaccgcatacaagaccagcgggacaacgctgcagagaatcataaaaatctgccacatcatgtagctctgccagttgcgccggttgatgcacatcagaatgagaattcccgcatccactaaaagaatggcggatggaagcgcatagttgacagaccagccgcggtaccccaccacgaagtcaatcgccacaaccatcaggatggcgatcagcgtcaacacgatgatcttgcccttgtagccggattttcccaatatggcatagcgcagcaccagatagccgtacaacatcgccagccccggaatcgcactccagaacatctccgagtcgctgagtacattcagatagatcaaaagcgcctccacaagaatcgccacgaacagatagatgcggctaagcaacgccagacgcctcgtcatcgtccgcacattcggatacatgttttccacctcaaccgtcttctccagcaccgaatggcaaagcggacagcgctccgtctcgtctaatatttccacattacattgcttgcatctactcataatttactccattcgtctctatctcaaccgcaatcccgtctgccgcgatttttctgaaaaaacctctctgcaccgacgtgtcggtcagatcataactgaaactgaataccagcgtatccccgtaggaacagatcgttccctttaagtgctgccctttggacatggcaagaaacgcatggaacatctccacataaggacgatactcctcgcttacggagatattcccgatattggtcaccgtcgctgtgtttgcaagcgcagaggttgtgtatacatagcgcatcgccagatttttcaaaaacagcggtacgatacgcgctgcaagaagcttctcattggagacattgtaggaaaaaagcttctccagattctcccggctgatctggctgcgcaggctctcactgacactttttagcacttcctcaaatgtatagatctcctttgtcggatgaaattctgccgacaccatcacaaagaaattcttcgtcgtgatcgaattaaaataagggcgcagattgaccggcaccgcaacacgaaccggacgttcggaaggcatcccgtgcatgcactccgtgtagacgctccagacatataccgccaccagatactcattgatgctgactccgtacgcatggcagactttcttcaactccgggatcttcatgtagccgtgcatgacgccgaactctcccggcggcagcttttctccctttaaaagatatgcccgcttcgtctgataccccttctgggagctgtgcttgtaattcttgaggaagctgtcctcacggttcaacgaggtatcactgctcaaggaatctcccaccttttcgcgcagcttcggatgtgccagccgcagatactgataggtcagctccttgagaaaattgatgccacccataccgtcggtgagcacatgaaatacttcgagattgatgcggtatttataataggttacgcggaacatataactgtggttcttattctgccggatatagcggcacggaaacgcactttcctcccgcacacgcggtgccggcttgccgttttcctcaaaataataccagaacacgccctggcgcagccgcagattaaacccatcaaacttcggcagcaccatatccagtgcctgctgcagcaattcacggtccaccagctccgtgagcgtcacgctgatgcggtatacattgctcatgctctccccggctatcaccggaaacaaatgcgccgtattgtccagacggtcccagcggatctccctctgtgcctctcttgcacggcgttttttcccttttacctggacagcttccttctgctcttcggccgctgttacctgatcctttttcttcatatattaaatgctcttttcctgtatagattctgttgcaattctgtcttacccgtagttccaatcttatcatacttcctattgtttgtccatgacacccacgcccgccattctttctaaaaatttcagactttatctcttgcattttattcgttttttttctaaaatatctgtgtggtatttggatataccagaaaagagaggctcacattatgttgtttaagaaattaagtgctccttctttaaaggagctttttgttgcagaattagagggaatgatattatccggaaagcttgagataggcgcaaaacttccgcctgagcgcgagcttgccgagtccatgcaggtatcgcgcgccgtcgtcaattccggtctggacgagatggagaaaaagggatttcttgtggtcaaaccacgaatcggcaccttcgttgccgactaccgcaaatacggtaccgcagacaccctagtctccatcatgcagtacaacggcggtatgctccgcgacaaggaagtgcgctccattctggaagtccgcatcatgttcatgaatcttgccgccacgctcgccatcgacaatgcggatgacgcgtccatcgccgggctcgagcagtatgtgaccgccttaaaggcatgcgaagatcctgaggaggctgcatcgctgatctttgacttcagccacgagctttccttcatcggcggcaattcgctgctcccgctgtttttcgcctccttcaaggatctggtgacaaacctgtgggtgcgcttcgccagcaagtacggcgcagcggcgctcgctgagagcgcggagcagattttcattcacgtgcgggaccgcgacaaagacgccgccatccgctatatcacggactccaccaacgaaagtattgacggctgccgccagatctatatgtaggcaccgcttccggtcagaataaatttttgacgtgctaagtaattgaagggagaatcattcctttccatttcaggcggaatgcatctggaaattcggatcaaaaaatgtggcatttctaaacaaccggtttttgcatctgcgatgatccgtgtttttccaagttttgagcactccacagaatgtgtccgcaatccgcagacaattttaggacttttttgtgtgtcccttatgggcacctctaaacataacataaccgcgcgaagccgctgtctgagccggcatctgccctgttttcaatagcagatgccggcgagttcggttcgcgcggttttatattgtctgtgaagaggtgcccttagggacaccagaaagtccgctcattgtctgcggtttgtcggacacattccgtggattgtcaaaacgtagaagagacacggaatccgatgcaaaaatccggtcggaagaaatgcacgcatttttttcaacgaatgttccatctgcatttccgcctgaaatcggttggatatgcctcttatcctattacttagcacgtcacactaatctatgacgtctttgcaaactggctgttatacagcttcgcatagaatccgttcttttccagaagttcctcgtgatttccctgctcaatgatgcttccatccttcatgaccagaatgatgtccgcctcgcggatcgtcgagagacggtgtgccacgataaaactggtgcgtccctgcatcatctttgcaaacgcattctgaatcttgatctcagtacgcgtatcaatcgaggatgtcgcctcatcaagaatcagcatcggaggcaggcacagcatgactcttgcaatgcataacagctgcttctgtccctgtgacaggttgccgccatcctctgcgatcacggtgtcatatccctccggcagacgcttgataaagccgtgtgcatgggatgcctttgcggccgcaatgatctcctcgtccgtggcgtccggttttcccatcgcaatgttgtcccggatgcttccgctccgaagccaggtctcctgcagcaccataccgtagttgtcccggagactcttgcgtgtcagctgctgcagcggaatatcgctgactttgattgtgccactgttcatatcatagaagcgcatcagcagattgatcaacgttgtcttgccgcatccggtcggtcccacgatcgccactcgctgtcccggcttcaccgacagattaaagtcctcaatcagcttctgctccggcacataggaaaaatagacatgtgaaagctcgaccttaccgtttgcatgctctaaatctaccgcgtcctcggcatccggcacctcggcatcctcctcaatcagctctatcactctgcccgcacacgcaagcgcattctgaagctccgtgatgacgcccgaaatctcgttgaacggcttcgtatactggttcgcgtaggacaaaagactcgacagctgtccgacactgatccctccggcaatcgccgaaaaagctccgacaactcctaccgttgcatagacaaggctgttgacaaaacgcgtcgacgggttggtaatactcgaaaagaaaatcgcccgcagagaatacttctgcagtctttcattgatctcatcaaacttctcaagcgcctcatcttcatgtgaaaatgcctgcaccactttctggttgccgaccatctcctcaataaacgccgtctgttctcccctcgtctctgactgcagcttgaacatggaaaatgtc

(The sequence listing continues in the following parts.)

The invention claimed is:

1. A method of treating an asthma in a subject in need thereof, comprising administering to the subject a therapeutically effective amount of a pharmaceutical composition that comprises a bacteria strain of the genus *Roseburia*, wherein the bacteria strain comprises the 16s rRNA gene sequence of SEQ ID NO:3.

2. A method of treating an asthma in a subject in need thereof, comprising administering to the subject a therapeutically effective amount of a pharmaceutical composition that comprises a bacteria strain of the genus *Roseburia*, wherein the bacteria strain is a *Roseburia hominis* strain 433 deposited with the NCIMB under accession number NCIMB 42383.

3. The method of claim 1, wherein the asthma is selected from the group consisting of neutrophilic asthma, allergic asthma, and a combination thereof.

4. The method of claim 1, wherein the administering reduces the level of neutrophils or eosinophils in a lung tissue of the subject, as compared to a level prior to the administering.

5. The method of claim 1, wherein the administering reduces inflammation in a lung tissue of the subject, as compared to prior to the administering.

6. The method of claim 1, wherein the administering reduces an amount of at least one pro-inflammatory cytokine in a lung tissue of the subject, as compared to prior to the administering.

7. The method of claim 6, wherein the pro-inflammatory cytokine is associated with the Th17 pathway.

8. The method of claim 6, wherein the pro-inflammatory cytokine is selected from the group consisting of IL-9, IL-1, IFN-γ, IL-17, IL-4, IL-5, RANTES, MIP-la, KC, and MIP-2.

9. The method of claim 1, wherein the administering is oral.

10. The method of claim 1, wherein the therapeutically effective amount comprises from about $1 \times 10^3$ to about $1 \times 10^{11}$ CFU/g of the bacteria strain with respect to a total weight of the pharmaceutical composition.

11. The method of claim 1, wherein the subject is human.

12. The method of claim 2, wherein the asthma is selected from the group consisting of neutrophilic asthma, allergic asthma, and a combination thereof.

13. The method of claim 2, wherein the administering reduces the level of neutrophils or eosinophils in a lung tissue of the subject, as compared to a level prior to the administering.

14. The method of claim 2, wherein the administering reduces inflammation in a lung tissue of the subject, as compared to prior to the administering.

15. The method of claim 2, wherein the administering reduces an amount of at least one pro-inflammatory cytokine in a lung tissue of the subject, as compared to prior to the administering.

16. The method of claim 15, wherein the pro-inflammatory cytokine is associated with the Th17 pathway.

17. The method of claim 15, wherein the pro-inflammatory cytokine is selected from the group consisting of IL-9, IL-1, IFN-$\gamma$, IL-17, IL-4, IL-5, RANTES, MIP-1a, KC, and MIP-2.

18. The method of claim 2, wherein the administering is oral.

19. The method of claim 2, wherein the therapeutically effective amount comprises from about $1 \times 10^3$ to about $1 \times 10^{11}$ CFU/g of the bacteria strain with respect to a total weight of the pharmaceutical composition.

20. The method of claim 2, wherein the subject is human.

* * * * *